(12) United States Patent
Davis et al.

(10) Patent No.: US 7,629,157 B2
(45) Date of Patent: Dec. 8, 2009

(54) KETOREDUCTASE POLYPEPTIDES AND RELATED POLYNUCLEOTIDES

(75) Inventors: S. Christopher Davis, San Francisco, CA (US); Gjalt W. Huisman, San Carlos, CA (US); Stephane J. Jenne, Burlingame, CA (US); Anke Kebber, Palo Alto, CA (US); Lisa Marie Newman, Redwood City, CA (US)

(73) Assignee: Codexis, Inc., Redwood City, CA (US)

( * ) Notice: Subject to any disclaimer, the term of this patent is extended or adjusted under 35 U.S.C. 154(b) by 428 days.

(21) Appl. No.: 10/916,311

(22) Filed: Aug. 11, 2004

(65) Prior Publication Data

US 2006/0195947 A1 Aug. 31, 2006

Related U.S. Application Data

(60) Provisional application No. 60/545,682, filed on Feb. 18, 2004, provisional application No. 60/494,195, filed on Aug. 11, 2003.

(51) Int. Cl.
*C12N 9/02* (2006.01)
*C12P 7/42* (2006.01)

(52) U.S. Cl. ...................... 435/189; 435/146
(58) Field of Classification Search ........................ None
See application file for complete search history.

(56) References Cited

U.S. PATENT DOCUMENTS

| | | | |
|---|---|---|---|
| 6,001,615 A | 12/1999 | Reeve | |
| 6,344,569 B1 | 2/2002 | Mitsuda et al. | |
| 6,472,544 B1 | 10/2002 | Kizaki et al. | |
| 6,492,868 B2 | 12/2002 | Kirn | .......................... 330/10 |
| 6,535,058 B1 | 3/2003 | Kirn | .......................... 330/10 |
| 6,596,879 B2 | 7/2003 | Bosch et al. | |
| 6,645,746 B1 | 11/2003 | Kizaki et al. | |
| 6,689,591 B2 | 2/2004 | Müller et al. | |
| 7,125,693 B2 * | 10/2006 | Davis et al. | .................. 435/128 |
| 7,132,267 B2 * | 11/2006 | Davis et al. | .................. 435/128 |
| 2002/0045233 A1 | 4/2002 | Hershberger et al. | |

FOREIGN PATENT DOCUMENTS

| | | |
|---|---|---|
| EP | 1416050 A | 5/2004 |
| WO | WO-98/35025 A | 8/1998 |
| WO | WO 00/28658 | 5/2000 |

OTHER PUBLICATIONS

Yasohara et al, "Molecular Cloning and Overexpression of the Gene Encoding an NADPH-Dependent Carbonyl Reductase from Candida Magnoliae, Involved in Stereoselective Reduction of Ethyl 4-Chloro-3-Oxobutanoate", Bioscience Biotechnology Biochemistry, Japan Soc. For Bioscience, Biotechnology and Agrochem., Tokyo, JP, vol. 64 No. 7, Jul. 2000, pp. 1430-1436, XP001105969 ISSN: 0916-8451.
Joernwall et L, "Short-Chain Dehydrogenases/Reductases (SDR)", Biochemistry, American Chemical Society, Easton, PA, USA, vol. 34 No. 18, May 9, 1995, pp. 6003-6013, XP000929805, ISSN: 0006-2960.

* cited by examiner

*Primary Examiner*—Delia M Ramirez
*Assistant Examiner*—Younus Meah
(74) *Attorney, Agent, or Firm*—Dechert LLP

(57) ABSTRACT

The present invention is directed to variant polypeptides having enhanced ketoreductase activity and/or thermostability for use in the stereospecific reduction of ketones. In addition, the present invention is directed to polynucleotides that encode the ketoreductase polypeptides, including codon optimized versions of the polynucleotides which provide for enhanced expression in host cells. In another aspect, the present invention is directed to nucleotide constructs, vectors and host cells that are transformed with polynucleotides of the present invention.

11 Claims, 10 Drawing Sheets

| SEQ ID NO: (or Prior Art Ref) | WO200155342 | WO200253728 | WO200266616 | WO200286090 | WO9835025 |
|---|---|---|---|---|---|
| (WO200155342) | 100.0 | 45.8 | 47.4 | 49.7 | 100.0 |
| (WO200253728) | 45.8 | 100.0 | 40.1 | 42.3 | 45.8 |
| (WO200266616) | 47.4 | 40.1 | 100.0 | 44.9 | 47.4 |
| (WO200286090) | 49.7 | 42.3 | 44.9 | 100.0 | 49.7 |
| (WO9835025) | 100.0 | 45.8 | 47.4 | 49.7 | 100.0 |
| 542 | 98.6 | 45.8 | 46.7 | 50.2 | 98.6 |
| 540 | 98.6 | 45.5 | 46.7 | 49.8 | 98.6 |
| 538 | 98.2 | 45.5 | 46.3 | 49.8 | 98.2 |
| 536 | 97.5 | 45.1 | 46.3 | 49.3 | 97.5 |
| 534 | 98.2 | 45.1 | 46.7 | 49.8 | 98.2 |
| 532 | 97.9 | 44.8 | 46.3 | 49.5 | 97.9 |
| 530 | 98.6 | 45.1 | 46.3 | 49.5 | 98.6 |
| 528 | 97.9 | 45.8 | 46.7 | 49.5 | 97.9 |
| 526 | 98.2 | 44.8 | 46.3 | 49.5 | 98.2 |
| 524 | 98.2 | 45.1 | 46.7 | 49.8 | 98.2 |
| 522 | 98.6 | 45.5 | 46.3 | 49.8 | 98.6 |
| 520 | 97.9 | 44.8 | 46.7 | 49.8 | 97.9 |
| 518 | 97.9 | 44.8 | 46.7 | 49.8 | 97.9 |
| 516 | 97.9 | 44.4 | 46.3 | 49.5 | 97.9 |
| 514 | 98.6 | 44.8 | 46.7 | 49.3 | 98.6 |
| 512 | 98.2 | 45.1 | 46.7 | 49.8 | 98.2 |
| 510 | 98.2 | 44.8 | 46.3 | 49.3 | 98.2 |
| 508 | 97.5 | 45.1 | 46.0 | 49.0 | 97.5 |
| 506 | 98.6 | 45.5 | 46.3 | 49.8 | 98.6 |
| 504 | 98.2 | 45.1 | 46.3 | 49.8 | 98.2 |
| 502 | 98.9 | 45.5 | 46.3 | 49.5 | 98.9 |
| 500 | 98.6 | 45.5 | 46.3 | 49.0 | 98.6 |
| 498 | 98.6 | 44.8 | 46.7 | 49.3 | 98.6 |
| 496 | 98.6 | 45.5 | 46.7 | 49.7 | 98.6 |
| 494 | 98.6 | 45.5 | 46.3 | 49.3 | 98.6 |
| 492 | 98.2 | 44.8 | 47.0 | 49.0 | 98.2 |
| 490 | 98.9 | 45.1 | 46.7 | 49.3 | 98.9 |
| 488 | 97.9 | 45.1 | 46.7 | 49.7 | 97.9 |
| 486 | 98.2 | 44.8 | 46.7 | 49.3 | 98.2 |
| 484 | 97.9 | 45.5 | 46.0 | 49.0 | 97.9 |
| 482 | 98.9 | 45.1 | 46.7 | 49.3 | 98.9 |
| 480 | 98.6 | 45.8 | 46.3 | 49.5 | 98.6 |
| 478 | 98.2 | 45.5 | 46.3 | 49.2 | 98.2 |

FIG. 2A

| SEQ ID NO: | WO200155342 | WO200253728 | WO200266616 | WO200286090 | WO9835025 |
|---|---|---|---|---|---|
| 476 | 98.9 | 45 | 46.3 | 49.7 | 98.9 |
| 474 | 98.6 | 45.8 | 46.3 | 49.7 | 98.6 |
| 472 | 98.2 | 46.2 | 46.3 | 49.2 | 98.2 |
| 470 | 98.2 | 45.1 | 46.7 | 49.0 | 98.2 |
| 468 | 98.6 | 45.5 | 46.0 | 49.0 | 98.6 |
| 466 | 98.6 | 45.1 | 47.0 | 49.3 | 98.6 |
| 464 | 98.9 | 45.1 | 46.7 | 49.3 | 98.9 |
| 462 | 98.9 | 45.5 | 46.3 | 49.3 | 98.9 |
| 460 | 98.9 | 45.5 | 46.3 | 49.0 | 98.9 |
| 458 | 98.9 | 45.5 | 46.7 | 49.7 | 98.9 |
| 456 | 98.9 | 45.5 | 46.3 | 49.0 | 98.9 |
| 454 | 98.9 | 45.5 | 46.7 | 49.0 | 98.9 |
| 452 | 99.3 | 45.5 | 46.7 | 49.3 | 99.3 |
| 450 | 98.9 | 45.1 | 46.7 | 49.3 | 98.9 |
| 448 | 98.6 | 45.8 | 46.3 | 49.7 | 98.6 |
| 446 | 98.6 | 45.5 | 47.0 | 49.3 | 98.6 |
| 444 | 98.9 | 45.1 | 46.7 | 49.3 | 98.9 |
| 442 | 98.9 | 45.5 | 46.3 | 49.0 | 98.9 |
| 440 | 98.9 | 45.1 | 46.7 | 49.3 | 98.9 |
| 438 | 98.6 | 45.1 | 46.7 | 49.3 | 98.6 |
| 436 | 98.6 | 45.8 | 47.0 | 49.3 | 98.6 |
| 434 | 98.9 | 45.8 | 46.3 | 49.3 | 98.9 |
| 432 | 98.9 | 45.5 | 47.0 | 49.3 | 98.9 |
| 430 | 98.6 | 45.8 | 47.0 | 49.0 | 98.6 |
| 428 | 98.9 | 45.5 | 47.0 | 49.3 | 98.9 |
| 426 | 98.9 | 45.8 | 47.0 | 49.3 | 98.9 |
| 424 | 98.9 | 45.5 | 46.3 | 49.0 | 98.9 |
| 422 | 98.9 | 45.5 | 47.0 | 49.3 | 98.9 |
| 420 | 98.6 | 45.5 | 46.3 | 49.0 | 98.6 |
| 418 | 98.9 | 45.1 | 47.0 | 49.3 | 98.9 |
| 416 | 98.6 | 45.1 | 47.0 | 49.7 | 98.6 |
| 414 | 98.9 | 45.5 | 47.4 | 49.5 | 98.9 |
| 412 | 98.2 | 45.5 | 46.3 | 48.8 | 98.2 |
| 410 | 98.9 | 45.5 | 46.7 | 49.3 | 98.9 |
| 408 | 98.9 | 45.5 | 46.3 | 49.0 | 98.9 |
| 406 | 98.6 | 45.1 | 46.7 | 49.3 | 98.6 |
| 404 | 98.6 | 45.8 | 47.0 | 49.0 | 98.6 |
| 402 | 98.6 | 45.8 | 47.0 | 49.0 | 98.6 |

FIG. 2B

| SEQ ID NO: | WO200155342 | WO200253728 | WO200266616 | WO200286090 | WO9835025 |
|---|---|---|---|---|---|
| 400 | 98.6 | 45.1 | 46.3 | 49.0 | 98.6 |
| 398 | 98.6 | 45.8 | 46.7 | 49.8 | 98.6 |
| 396 | 98.6 | 45.1 | 46.3 | 49.3 | 98.6 |
| 394 | 98.9 | 45.5 | 46.7 | 49.0 | 98.9 |
| 392 | 98.9 | 45.5 | 46.3 | 49.3 | 98.9 |
| 390 | 98.9 | 45.5 | 46.7 | 49.3 | 98.9 |
| 388 | 98.9 | 45.1 | 46.7 | 49.3 | 98.9 |
| 386 | 98.9 | 45.1 | 46.7 | 49.3 | 98.9 |
| 384 | 98.6 | 46.5 | 46.7 | 49.3 | 98.6 |
| 382 | 98.9 | 45.5 | 46.7 | 49.3 | 98.9 |
| 380 | 98.9 | 45.5 | 46.3 | 49.3 | 98.9 |
| 378 | 98.9 | 45.1 | 46.7 | 49.3 | 98.9 |
| 376 | 98.9 | 45.5 | 46.7 | 49.3 | 98.9 |
| 374 | 98.9 | 45.8 | 46.3 | 49.0 | 98.9 |
| 372 | 98.9 | 45.5 | 47.0 | 49.0 | 98.9 |
| 370 | 98.9 | 45.5 | 46.7 | 49.3 | 98.9 |
| 368 | 98.9 | 46.5 | 46.7 | 49.0 | 98.9 |
| 366 | 98.6 | 45.1 | 46.3 | 49.0 | 98.6 |
| 364 | 98.6 | 45.1 | 46.3 | 49.0 | 98.6 |
| 362 | 98.6 | 45.1 | 46.3 | 49.0 | 98.6 |
| 360 | 98.9 | 46.2 | 47.7 | 49.7 | 98.9 |
| 358 | 98.6 | 45.5 | 46.3 | 49.2 | 98.6 |
| 356 | 98.2 | 45.1 | 46.3 | 49.0 | 98.2 |
| 354 | 98.9 | 45.5 | 46.3 | 49.0 | 98.9 |
| 352 | 98.6 | 45.5 | 46.7 | 49.0 | 98.6 |
| 350 | 99.3 | 45.5 | 47.0 | 49.3 | 99.3 |
| 348 | 98.9 | 45.1 | 47.0 | 49.3 | 98.9 |
| 346 | 98.6 | 46.2 | 47.0 | 50.3 | 98.6 |
| 342 | 97.2 | 45.5 | 47.4 | 48.6 | 97.2 |
| 340 | 99.3 | 45.8 | 46.7 | 49.7 | 99.3 |
| 338 | 98.6 | 45.5 | 46.7 | 49.0 | 98.6 |
| 336 | 98.9 | 45.8 | 47.0 | 49.7 | 98.9 |
| 334 | 98.9 | 45.5 | 46.7 | 49.3 | 98.9 |
| 332 | 99.3 | 45.8 | 47.0 | 49.7 | 99.3 |
| 330 | 99.3 | 45.5 | 47.0 | 49.7 | 99.3 |
| 344 | 99.3 | 45.5 | 46.7 | 49.3 | 99.3 |
| 328 | 99.6 | 45.8 | 47.0 | 49.7 | 99.6 |
| 326 | 98.6 | 45.8 | 46.7 | 49.7 | 98.6 |

FIG. 2C

| SEQ ID NO: | WO200155342 | WO200253728 | WO200266616 | WO200286090 | WO9835025 |
|---|---|---|---|---|---|
| 324 | 98.9 | 45.1 | 46.3 | 49.3 | 98.9 |
| 322 | 99.3 | 45.5 | 46.7 | 49.0 | 99.3 |
| 320 | 98.6 | 45.8 | 47.0 | 49.0 | 98.6 |
| 318 | 99.3 | 45.5 | 46.7 | 49.7 | 99.3 |
| 316 | 97.9 | 45.8 | 47.0 | 49.0 | 97.9 |
| 314 | 98.9 | 45.5 | 46.7 | 49.7 | 98.9 |
| 312 | 99.3 | 45.8 | 47.0 | 49.7 | 99.3 |
| 310 | 98.6 | 45.5 | 47.7 | 49.7 | 98.6 |
| 308 | 98.2 | 45.8 | 47.4 | 49.7 | 98.2 |
| 306 | 99.3 | 45.5 | 46.7 | 49.3 | 99.3 |
| 304 | 99.3 | 45.5 | 46.7 | 49.3 | 99.3 |
| 302 | 98.9 | 45.8 | 47.4 | 49.3 | 98.9 |
| 300 | 99.3 | 46.2 | 48.1 | 49.3 | 99.3 |
| 298 | 98.9 | 45.8 | 47.0 | 49.3 | 98.9 |
| 296 | 98.9 | 45.1 | 46.7 | 49.3 | 98.9 |
| 294 | 98.6 | 45.5 | 46.3 | 49.0 | 98.6 |
| 292 | 98.2 | 45.1 | 46.7 | 48.6 | 98.2 |
| 290 | 98.9 | 45.8 | 47.0 | 49.3 | 98.9 |
| 288 | 98.9 | 45.8 | 46.3 | 49.3 | 98.9 |
| 286 | 98.2 | 45.5 | 46.7 | 49.0 | 98.2 |
| 284 | 98.6 | 45.5 | 46.7 | 49.0 | 98.6 |
| 282 | 98.2 | 45.8 | 46.3 | 49.2 | 98.2 |
| 280 | 97.9 | 44.8 | 46.7 | 49.3 | 97.9 |
| 278 | 98.6 | 44.8 | 46.3 | 49.0 | 98.6 |
| 276 | 99.3 | 45.5 | 47.0 | 49.7 | 99.3 |
| 274 | 99.3 | 45.8 | 46.7 | 49.3 | 99.3 |
| 272 | 98.9 | 45.8 | 47.0 | 49.0 | 98.9 |
| 270 | 98.6 | 45.8 | 46.7 | 49.7 | 98.6 |
| 268 | 99.6 | 45.8 | 47.0 | 49.7 | 99.6 |
| 266 | 98.6 | 45.1 | 46.7 | 49.3 | 98.6 |
| 264 | 98.9 | 45.1 | 46.7 | 49.0 | 98.9 |
| 262 | 98.9 | 45.5 | 46.3 | 49.0 | 98.9 |
| 260 | 98.9 | 46.2 | 47.7 | 49.3 | 98.9 |
| 258 | 99.6 | 45.8 | 47.0 | 49.7 | 99.6 |
| 256 | 98.2 | 45.5 | 47.7 | 49.0 | 98.2 |
| 254 | 99.3 | 45.5 | 46.7 | 49.3 | 99.3 |
| 252 | 99.3 | 45.8 | 47.0 | 49.7 | 99.3 |
| 250 | 98.9 | 45.5 | 47.0 | 49.3 | 98.9 |

FIG. 2D

| SEQ ID NO: | WO200155342 | WO200253728 | WO200266616 | WO200286090 | WO9835025 |
|---|---|---|---|---|---|
| 248 | 99.3 | 45.5 | 46.7 | 49.3 | 99.3 |
| 246 | 98.9 | 45.1 | 47.0 | 49.0 | 98.9 |
| 244 | 98.9 | 45.5 | 46.7 | 49.0 | 98.9 |
| 242 | 99.3 | 45.5 | 46.7 | 49.3 | 99.3 |
| 240 | 96.1 | 45.5 | 47.0 | 48.6 | 96.1 |
| 238 | 96.5 | 46.5 | 47.4 | 49.0 | 96.5 |
| 236 | 97.2 | 46.5 | 48.1 | 49.7 | 97.2 |
| 234 | 97.2 | 45.8 | 47.4 | 49.0 | 97.2 |
| 232 | 98.6 | 45.8 | 48.1 | 49.0 | 98.6 |
| 230 | 97.2 | 46.2 | 48.1 | 48.6 | 97.2 |
| 228 | 96.1 | 47.2 | 46.7 | 49.0 | 96.1 |
| 226 | 99.3 | 45.8 | 47.4 | 49.7 | 99.3 |
| 224 | 99.6 | 45.8 | 47.0 | 49.7 | 99.6 |
| 222 | 98.6 | 46.5 | 48.1 | 49.7 | 98.6 |
| 220 | 98.9 | 47.2 | 48.4 | 49.7 | 98.9 |
| 218 | 97.5 | 45.5 | 48.1 | 50.0 | 97.5 |
| 216 | 98.9 | 46.2 | 48.1 | 49.3 | 98.9 |
| 214 | 98.2 | 46.2 | 47.4 | 49.0 | 98.2 |
| 212 | 98.2 | 46.5 | 47.0 | 49.5 | 98.2 |
| 210 | 97.5 | 46.2 | 48.1 | 49.3 | 97.5 |
| 208 | 98.9 | 46.2 | 48.4 | 49.3 | 98.9 |
| 206 | 98.6 | 45.8 | 47.7 | 49.0 | 98.6 |
| 204 | 98.2 | 45.5 | 48.1 | 49.0 | 98.2 |
| 202 | 97.5 | 46.9 | 47.7 | 49.0 | 97.5 |
| 200 | 95.1 | 46.2 | 47.4 | 49.7 | 95.1 |
| 198 | 95.8 | 45.8 | 47.7 | 49.0 | 95.8 |
| 196 | 99.3 | 46.2 | 48.1 | 49.7 | 99.3 |
| 194 | 97.2 | 46.5 | 48.8 | 48.6 | 97.2 |
| 192 | 96.1 | 46.9 | 48.1 | 48.0 | 96.1 |
| 190 | 97.9 | 45.8 | 48.1 | 49.0 | 97.9 |
| 188 | 98.6 | 46.2 | 48.4 | 49.0 | 98.6 |
| 186 | 98.6 | 46.5 | 48.1 | 49.3 | 98.6 |
| 184 | 96.5 | 45.8 | 46.7 | 48.3 | 96.5 |
| 182 | 98.2 | 45.8 | 48.4 | 49.3 | 98.2 |
| 180 | 98.6 | 46.2 | 47.4 | 49.0 | 98.6 |
| 178 | 98.2 | 46.2 | 48.4 | 49.3 | 98.2 |
| 176 | 98.2 | 46.5 | 48.1 | 49.3 | 98.2 |
| 174 | 97.2 | 45.5 | 48.4 | 49.3 | 97.2 |
| 172 | 97.5 | 46.5 | 47.4 | 48.6 | 97.5 |

FIG. 2E

| SEQ ID NO: | WO200155342 | WO200253728 | WO200266616 | WO200286090 | WO9835025 |
|---|---|---|---|---|---|
| 170 | 97.5 | 45.8 | 47.7 | 49.3 | 97.5 |
| 168 | 97.5 | 46.2 | 47.4 | 49.0 | 97.5 |
| 166 | 97.9 | 46.5 | 48.1 | 48.6 | 97.9 |
| 164 | 98.2 | 46.5 | 47.7 | 49.7 | 98.2 |
| 162 | 98.9 | 46.2 | 48.1 | 49.7 | 98.9 |
| 160 | 97.2 | 45.8 | 47.7 | 49.0 | 97.2 |
| 158 | 97.5 | 46.2 | 48.1 | 49.7 | 97.5 |
| 156 | 98.6 | 46.5 | 47.7 | 50.0 | 98.6 |
| 154 | 98.9 | 45.8 | 47.7 | 49.3 | 98.9 |
| 152 | 98.6 | 46.5 | 47.7 | 50.0 | 98.6 |
| 150 | 96.8 | 47.2 | 47.7 | 49.0 | 96.8 |
| 148 | 98.2 | 46.5 | 48.1 | 49.0 | 98.2 |
| 146 | 98.2 | 46.5 | 48.4 | 49.0 | 98.2 |
| 144 | 98.2 | 46.5 | 47.7 | 49.3 | 98.2 |
| 142 | 95.8 | 45.8 | 47.7 | 48.0 | 95.8 |
| 140 | 98.2 | 46.5 | 48.1 | 49.0 | 98.2 |
| 138 | 97.2 | 46.9 | 47.7 | 49.0 | 97.2 |
| 136 | 98.6 | 46.5 | 48.4 | 49.0 | 98.6 |
| 134 | 96.1 | 45.8 | 48.4 | 48.6 | 96.1 |
| 132 | 97.5 | 46.2 | 48.4 | 48.6 | 97.5 |
| 130 | 95.8 | 46.2 | 47.7 | 48.6 | 95.8 |
| 128 | 98.2 | 46.5 | 48.4 | 49.0 | 98.2 |
| 126 | 97.2 | 46.5 | 48.4 | 48.3 | 97.2 |
| 124 | 97.5 | 45.8 | 47.7 | 48.6 | 97.5 |
| 122 | 95.8 | 45.5 | 48.4 | 47.6 | 95.8 |
| 120 | 97.9 | 46.2 | 48.4 | 49.0 | 97.9 |
| 118 | 97.2 | 47.2 | 48.1 | 49.0 | 97.2 |
| 116 | 98.2 | 46.9 | 48.1 | 49.7 | 98.2 |
| 114 | 96.8 | 45.8 | 48.4 | 49.0 | 96.8 |
| 112 | 97.5 | 46.2 | 47.7 | 48.6 | 97.5 |
| 110 | 98.2 | 46.5 | 48.1 | 49.3 | 98.2 |
| 108 | 98.2 | 45.8 | 48.1 | 49.0 | 98.2 |
| 106 | 96.1 | 47.2 | 47.7 | 49.3 | 96.1 |
| 104 | 98.2 | 45.8 | 47.7 | 49.0 | 98.2 |
| 102 | 98.9 | 46.2 | 48.4 | 49.3 | 98.9 |
| 100 | 97.2 | 46.9 | 47.7 | 49.3 | 97.2 |
| 98 | 98.6 | 46.2 | 47.4 | 49.3 | 98.6 |
| 96 | 99.6 | 45.8 | 47.0 | 49.7 | 99.6 |

FIG. 2F

| SEQ ID NO: | WO200155342 | WO200253728 | WO200266616 | WO200286090 | WO9835025 |
|---|---|---|---|---|---|
| 94 | 99.3 | 46.2 | 47.0 | 50.0 | 99.3 |
| 92 | 99.6 | 45.8 | 47.7 | 49.3 | 99.6 |
| 90 | 98.9 | 45.5 | 47.0 | 49.7 | 98.9 |
| 88 | 99.6 | 45.8 | 47.4 | 50.0 | 99.6 |
| 86 | 99.6 | 45.5 | 47.4 | 49.7 | 99.6 |
| 84 | 99.3 | 45.8 | 47.7 | 49.3 | 99.3 |
| 82 | 99.3 | 45.8 | 47.4 | 49.7 | 99.3 |
| 80 | 99.6 | 45.8 | 47.4 | 49.3 | 99.6 |
| 78 | 99.3 | 46.2 | 48.1 | 49.7 | 99.3 |
| 76 | 99.3 | 46.2 | 48.1 | 49.7 | 99.3 |
| 74 | 99.6 | 46.2 | 47.4 | 49.3 | 99.6 |
| 72 | 99.6 | 45.8 | 47.4 | 49.7 | 99.6 |
| 70 | 99.6 | 45.8 | 47.7 | 49.3 | 99.6 |
| 68 | 98.9 | 45.5 | 47.4 | 50.0 | 98.9 |
| 66 | 98.9 | 45.8 | 48.1 | 49.0 | 98.9 |
| 64 | 99.6 | 45.8 | 47.4 | 49.7 | 99.6 |
| 62 | 99.6 | 45.5 | 47.0 | 49.3 | 99.6 |
| 60 | 99.6 | 45.8 | 47.4 | 49.7 | 99.6 |
| 58 | 99.6 | 45.8 | 47.7 | 50.0 | 99.6 |
| 56 | 99.3 | 45.5 | 47.4 | 49.7 | 99.3 |
| 54 | 99.3 | 46.2 | 48.1 | 49.7 | 99.3 |
| 52 | 99.6 | 45.8 | 47.4 | 49.7 | 99.6 |
| 50 | 99.6 | 45.8 | 47.4 | 49.7 | 99.6 |
| 48 | 99.6 | 46.5 | 47.4 | 49.7 | 99.6 |
| 46 | 99.3 | 45.8 | 47.0 | 49.3 | 99.3 |
| 44 | 99.6 | 45.8 | 47.4 | 49.7 | 99.6 |
| 42 | 98.6 | 45.8 | 47.4 | 50.0 | 98.6 |
| 40 | 99.6 | 45.8 | 47.7 | 49.7 | 99.6 |
| 38 | 98.9 | 45.8 | 47.0 | 48.6 | 98.9 |
| 36 | 99.3 | 46.2 | 47.4 | 50.0 | 99.3 |
| 34 | 99.3 | 45.5 | 47.4 | 49.3 | 99.3 |
| 32 | 99.6 | 45.5 | 47.7 | 49.3 | 99.6 |
| 30 | 99.3 | 45.8 | 47.7 | 49.3 | 99.3 |
| 28 | 99.6 | 46.2 | 47.4 | 49.3 | 99.6 |
| 26 | 99.3 | 45.5 | 48.1 | 49.0 | 99.3 |
| 24 | 99.3 | 46.2 | 47.0 | 49.0 | 99.3 |
| 22 | 99.6 | 45.5 | 47.7 | 49.3 | 99.6 |
| 20 | 99.6 | 45.8 | 47.7 | 49.3 | 99.6 |
| 18 | 99.6 | 45.8 | 47.4 | 49.7 | 99.6 |

FIG. 2G

| SEQ ID NO: | WO200155342 | WO200253728 | WO200266616 | WO200286090 | WO9835025 |
|---|---|---|---|---|---|
| 16 | 99.3 | 45.8 | 46.7 | 50.0 | 99.3 |
| 14 | 99.6 | 45.5 | 47.0 | 49.3 | 99.6 |
| 12 | 99.6 | 45.5 | 47.0 | 49.3 | 99.6 |
| 10 | 99.6 | 45.8 | 47.0 | 49.7 | 99.6 |
| 8 | 99.3 | 45.5 | 47.0 | 49.3 | 99.3 |
| 6 | 99.3 | 46.2 | 47.0 | 50.0 | 99.3 |
| 4 | 99.3 | 46.2 | 47.0 | 50.0 | 99.3 |
| 2 (CR2-05) | 100.0 | 45.8 | 47.4 | 49.7 | 100.0 |

FIG. 2H

KETOREDUCTASE POLYPEPTIDES AND RELATED POLYNUCLEOTIDES

This application claims benefit under 35 U.S.C. § 119(e) of U.S. application Ser. No. 60/545,682, filed Feb. 18, 2004, and U.S. application Ser. No. 60/494,195, filed Aug. 11, 2003.

FIELD OF THE INVENTION

The present invention is related to the field of enzymology, and particularly to the field of ketoreductase enzymology. More specifically, the present invention is directed to ketoreductase polypeptides having improved enzymatic activity, and to the polynucleotide sequences that encode for the improved ketoreductase polypeptides.

BACKGROUND OF THE INVENTION

Chiral γ-substituted β-hydroxybutyric acid esters are commercially important intermediates in the synthesis of pharmaceuticals. These intermediates may be utilized as optically active intermediates in the synthesis of HMG-CoA reductase inhibitors, such as Atorvastatin, Fluvastatin, and Rosuvastatin. Methods have been described for producing some γ-substituted β-hydroxybutyric acid esters. For example, a method has been reported for producing 4-cyano-3-hydroxybutyric acid from 4-bromo-3-hydroxybutyrate that requires the protection of the hydroxy group with a protecting group prior to reaction with sodium cyanide. *Acta Chem. Scand., B*37, 341 (1983). Isbell, et al. further report a method for synthesizing (R)-4-cyano-3-hydroxybutyric acid ester by reacting the monohydrate calcium salt of threonine with hydrogen bromide to produce the di-bromo form of threonine, which is then converted to bromohydrin. *Carbohydrate Res., 72*:301 (1979). The hydroxy group of the bromohydrin is protected prior to reaction with sodium cyanide. Id. Unfortunately, methods requiring protecting and deprotecting steps are not practical to implement commercially.

More recent routes to synthesizing cyanohydrins have been developed that utilize ethyl 4-bromo-3-hydroxybutyrate. These routes require a large number of steps that are relatively costly to carry out commercially.

Description of Ketoreductase

KRED Characterization

Enzymes belonging to the ketoreductase (KRED) or carbonyl reductase class (EC 1.1.1.184) are useful for the synthesis of optically active alcohols from the corresponding prochiral ketone substrate. KREDs typically convert a ketone substrate to the corresponding alcohol product, but may also catalyze the reverse reaction, oxidation of an alcohol substrate to the corresponding ketone/aldehyde product. The reduction of ketones and the oxidation of alcohols by enzymes such as KRED, requires a co-factor, most commonly reduced nicotinamide adenine dinucleotide (NADH) or reduced nicotinamide adenine dinucleotide phosphate (NADPH), and nicotinamide adenine dinucleotide (NAD) or nicotinamide adenine dinucleotide phosphate (NADP) for the oxidation reaction. NADH and NADPH serve as electron donors, while NAD and NADP serve as electron acceptors. It is frequently observed that ketoreductases and alcohol dehydrogenases accept either the phosphorylated or the non-phosphorylated co-factor (in its oxidized and reduced state), but not both.

KRED enzymes can be found in a wide range of bacteria and yeasts (for reviews: Kraus and Waldman, Enzyme catalysis in organic synthesis Vol's 1&2. VCH Weinheim 1995; Faber, K., Biotransformations in organic chemistry, 4$^{th}$ Ed. Springer, Berlin Heidelberg New York. 2000; Hummel and Kula Eur. J. Biochem. 1989 184:1-13; Liese). Several KRED gene and enzyme sequences have been reported, e.g. *Candida magnoliae* (Genbank Acc. No. JC7338; GI:11360538) *Candida parapsilosis* (Genbank Acc. No. BAA24528.1; GI:2815409), *Sporobolomyces salmonicolor* (Genbank Acc. No. AF160799; GI:6539734).

Desired KRED Properties

Metabolism in the living cell ensures the adequate supply of co-factors for reduction reactions by de novo synthesis and regeneration. The use of whole cells for biocatalytic ketone reductions may therefore be advantageous, however, microorganisms typically have multiple ketoreductases which can lead to low product of low enantiomeric excess. For that reason, Wong et al. studied (semi)-purified ketoreductases enzymes and found that higher quality products can be obtained (Wong et al. J. Am. Chem. Soc 1985 107:4028-4031).

In the absence of the cellular machinery during in vitro enzymatic reductions, co-factor regeneration is needed to circumvent the need for stoichiometric amounts of these expensive molecules. The use of enzymes for reduction of ketones therefore requires two enzymes—KRED and a cofactor (NADH or NADPH) regenerating enzyme such as glucose dehydrogenase (GDH), formate dehydrogenase etc. Enzymes are generally considered expensive due to their low activity under process conditions (e.g. Sutherland and Willis, J. Org. Chem. 1998 63:7764; Bustillo et al. Tetrahedron Assym 2002 13:1681), insufficient stability (Shimizu et al. Appl. Environ. Microbiol. 1990 56:2374; Bradshaw et al. J. Org. Chem. 1992 57:1526), and vulnerability to substrate or product inhibition (Kataoka et al. Appl. Microbiol. Biotechnol. 1997 48:699); Kita et al. Appl. Environ. Microbiol. 1999 65: 5207). As mentioned above, co-factors are expensive reagents for industrial processes and may add significant cost to a biological reduction process if their usage is not efficient.

To circumvent many of these perceived economic issues, whole microbial cells have been frequently considered as preferred catalyst for biocatalytic reductions, as they typically contain co-factor and co-factor regenerating enzymes. Asymmetric reduction of 4-chloroacetoacetate esters has been described with bakers yeast (Zhou, J. Am. Chem. Soc. 1983 105:5925-5926; Santaniello, J. Chem. Res. (S) 1984: 132-133) and many other microorganisms (U.S. Pat. Nos. 5,559,030; 5,700,670 and 5,891,685). However, reductions using microbial cells are not performed at high substrate concentration are not efficient, suffer from reduced yield due to competing reactions and give low enantiomeric excess ("e.e.") (U.S. Pat. Nos. 5,413,921; 5,559,030; 5,700,670; 5,891,685; 6,218,156; and 6,448,052).

Introduction of genes encoding KRED and GDH into a fast-growing microorganism such as *E. coli* has resulted in more active whole cell catalysts for the reduction of ketones. The carbonyl reductase gene from *Candida magnoliae* and the GDH gene from *Bacillus megaterium* were cloned in *E. coli* and allowed for the production of ethyl-4-chloro-3-hydroxybutyrate. To achieve a significant productivity, the NADP co-factor was added to the reaction to provide sufficient activity to the catalyst. At the end of the reaction, the chiral product was extracted and purified by common procedures such as chromatography and distillation. While this procedure is an improvement over processes that use native organisms, significant drawbacks for economic production still persist as NADP continues to be a required additive, and significant process investments are needed to isolate the product in a pure form from the reaction mixture that contains microbial cells.

With these caveats in both enzymatic and whole cell reduction processes in mind, it was an object of the present invention to describe the generation of enzymes, their amino acid sequences and the genes encoding such sequences that facilitate the efficient and economic reduction of ethyl-4-chloro-3-ketobutyrate and other ketones in a clean reaction process. Thus, while microbial reductions typically require cell concentrations of 5 g/L or more, new enzymes are described that catalyze these reactions at enzyme concentrations below 1 g/L, preferably below 0.5 g/L. In addition, the enzymes described, catalyze the complete conversion of at least 100 g/L substrate in less than 20 hrs and require only small amounts of co-factor.

The above referenced patents and publications and all other patents and publications cited throughout this specification are expressly incorporated by reference herein in their entirety.

BRIEF SUMMARY OF THE INVENTION

The present invention has multiple aspects. In one aspect, the present invention is directed to a ketoreductase ("KRED") polypeptide having enhanced KRED activity relative to a KRED of SEQ ID NO: 2, preferably having at least 1.5 times, typically 1.5 to 50 times, more typically from 1.5 to about 25 times, the KRED activity of SEQ ID NO: 2 as measured by the decrease in absorbance or fluorescence of NADPH due to its oxidation with the concomitant reduction of a ketone to the corresponding alcohol. In another aspect, the present invention is directed to a KRED polypeptide having at least 1.5 times, typically 1.5 to 50 times, more typically 1.5 to about 25 times the KRED activity of the polypeptide of SEQ ID NO: 2, such as measured by the decrease in absorbance or fluorescence of NADPH (e.g., Example 4) or by product produced in a coupled assay (e.g., Example 5), and being at least 90% homologous, preferably at least 95%, more preferably at least 97% and most preferably at least 99% homologous with the amino acid sequence of SEQ ID NO: 506, 520, 526, 536, and 538. In another aspect, the present invention is directed to a ketoreductase ("KRED") polypeptide having increased remaining KRED activity relative to a KRED of SEQ ID NO: 2, after treatment for 15-24 hours at 50° C., at least 1.5 times, typically 1.5 to 100 times, more typically from 1.5 to about 60 times, the KRED activity of SEQ ID NO: 2 as measured by the decrease in absorbance or fluorescence of NADPH due to its oxidation with the concomitant reduction of a ketone to the corresponding alcohol. In yet another aspect, the present invention is directed to a KRED polypeptide having increased remaining KRED activity relative to a KRED of SEQ ID NO: 2, after treatment for 15-24 hours at 50° C., at least 1.5 times, typically 1.5 to 100 times, more typically from 1.5 to about 60 times, the KRED activity of SEQ ID NO: 2, such as measured by the decrease in absorbance or fluorescence of NADPH (e.g., Example 4) or by product produced in a coupled assay (e.g., Example 5), and being at least 90% homologous, preferably at least 95%, more preferably at least 97% and most preferably at least 99% homologous with the amino acid sequence of SEQ ID NO: 506, 520, and 526. In one embodiment, the present invention is also directed to a variant KRED polypeptide, as described herein, in isolated and purified form. In another embodiment, the isolated and purified variant KRED polypeptide is in lyophilized form. In yet another embodiment, the present invention is directed to a composition comprising a variant KRED polypeptide as described herein and a suitable carrier, typically a buffer solution, more typically a buffer solution having a pH between 6.0 and 8.0. It is also within the scope of the invention that the buffered KRED composition is in lyophilized form.

In another aspect, a variant KRED polypeptide of the present invention differs from the reported sequence for the ketoreductase of Candida magnoliae of SEQ ID NO: 2 by 1-20 amino acid residues, typically by 1-10 amino acid residues, more typically by 1-9 amino acid residues, even more typically by 1-8 amino acid residues, and most typically by 1-7 amino acid residues. In another aspect, the present invention is directed to a KRED polypeptide (preferably, isolated and purified) having at least 1.5 times, typically, 1.5 to 50 times, more typically 1.5 to about 25 times the KRED activity of the polypeptide of SEQ ID NO: 2, and having the amino acid sequence of SEQ ID NO: 2 with one to twenty, preferably one to seven, of the following residue changes: A2V; K3E; F5L or C; N7K; E9G or K; A12V; P13L; P14A; A16G or V; T18A; K19I; N20D or S; E21K; S22N or T; Q24H or R; V25A; N32S or D; A36T; S41G; S42N; I45L; A48T; V56A; V60I; Y64H; N65K, D, Y or S; S66G or R; H67L or Q; D68G or N; G71D; E74K or G; K78R; K79R; K85R; A86V; N90D; S93N or C; D95N, G, V, Y or E; K98R; Q99L, R, or H; T100A; I101V; Q103R; I105V or T; K106R or Q; H110Y, C or R; V114A; A116G; I120V; K124R; D129G or N; D131G or V; D132N; K134M, V, E or R; D137N or G; Q138L; V140I; D143N; L144F; K145R; V147A; V150A; H153Y or Q; H157Y; F158L or Y; R159K; E160G or V; F162Y or S; E163G or K; E165D, G or K; K167I or R; A170S; V172I; F173C; M177V or T; H180Y; V184I; T190A; A193V; A194V; F201L; K203R; F209Y; V218I; N224S; E226K, G or D; S228T; D229A; V231I or A; Q233K or R; E234G or D; T235K or A; N237Y; K238R or E; T251A; V255A; F260L; A262V; T272A; I274L; I275L or V; and P283R.

In a preferred aspect of the above embodiment, the present invention is directed to a KRED polypeptide that has from 1.5 to about 25 times the KRED activity of the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 1. | S42N | SEQ ID NO: 224 |
| 2. | S42N, K124R, A194V | SEQ ID NO: 244 |
| 3. | S42N, A194V, K203R | SEQ ID NO: 246 |
| 4. | S42N, E160G, A194V | SEQ ID NO: 250 |
| 5. | S42N, D95Y | SEQ ID NO: 252 |
| 6. | S42N, A194V | SEQ ID NO: 254 |
| 7. | S42N, V140I, F158L, M177T, V184I | SEQ ID NO: 256 |
| 8. | H67Q, F158Y, T235K | SEQ ID NO: 260 |
| 9. | S42N, A194V, T235K | SEQ ID NO: 354 |
| 10. | E21K, S42N, K78R, A194V | SEQ ID NO: 358 |
| 11. | S42N, E163K, A194V | SEQ ID NO: 360 |
| 12. | S42N, V184I, A194V, T235K | SEQ ID NO: 364 |
| 13. | N7K, S42N, A194V | SEQ ID NO: 368 |
| 14. | S42N, D129N, A194V | SEQ ID NO: 374 |
| 15. | E9K, S42N, A194V | SEQ ID NO: 382 |
| 16. | S42N, D131G, A194V | SEQ ID NO: 386 |
| 17. | S42N, D131V, A194V | SEQ ID NO: 388 |
| 18. | S42N, D131G, A194V, T235K | SEQ ID NO: 400 |
| 19. | S42N, Q103R, A194V | SEQ ID NO: 408 |
| 20. | E9K, S42N, A194V, K238R | SEQ ID NO: 438 |
| 21. | S42N, V184I, A194V | SEQ ID NO: 440 |
| 22. | E9K, S42N, N90D, A194V | SEQ ID NO: 448 |
| 23. | E9K, S42N, D131G, A194V, Q233R | SEQ ID NO: 470 |
| 24. | E9K, S42N, D137N, D143N, A194V, K238R | SEQ ID NO: 484 |
| 25. | E9K, S42N, V147A, A194V, K238R | SEQ ID NO: 486 |
| 26. | E9K, S42N, S66R, A194V, F201L, K238R | SEQ ID NO: 488 |
| 27. | S42N, A194V, K238 E | SEQ ID NO: 490 |

| | | |
|---|---|---|
| 28. | S42N, V147A, A194V, K238R | SEQ ID NO: 498 |
| 29. | P14A, S42N, A194V | SEQ ID NO: 502 |
| 30. | P14A, S42N, T190A, A194V | SEQ ID NO: 506 |
| 31. | E9K S42N D137N D143N V147A A194V K238R | SEQ ID NO: 508 |
| 32. | P14A, S42N, V147A, A194V, I275V | SEQ ID NO: 512 |
| 33. | S42N, V147A, A194V, K238R | SEQ ID NO: 514 |
| 34. | P14A, S42N, G71D, V147A A194V K238R | SEQ ID NO: 516 |
| 35. | P14A S42N V147A A194V K238R I275V | SEQ ID NO: 518 |
| 36. | P14A N20D S42N V147A A194V I275V | SEQ ID NO: 520 |
| 37. | P14A S42N T190A A194V | SEQ ID NO: 522 |
| 38. | P14A S42N V147AA194V I275V | SEQ ID NO: 524 |
| 39. | P14A S42N V147A A194V K238R | SEQ ID NO: 526 |
| 40. | N7K P14A S42N V147A A194V I275V | SEQ ID NO: 528 |
| 41. | P14A S42N V147A A194V | SEQ ID NO: 530 |
| 42. | P14A N32S S42N V147A A194V K238R | SEQ ID NO: 532 |
| 43. | P14A S42N V147A A194V I275V | SEQ ID NO: 534 |
| 44. | E9G P14A N20S S42N T190A A194V E234G | SEQ ID NO: 536 |
| 45. | E9G P14A S42N T190A A194V | SEQ ID NO: 538 |
| 46. | P14A S42N A194V I275V | SEQ ID NO: 540 |
| 47. | E9G P14A S42N T190A | SEQ ID NO: 542 |

In the present application, all of the SEQ ID NOs of the KRED polypeptides are even numbered and all of the SEQ ID NOs of the polynucleotides are odd numbered. Moreover, each polypeptide of a particular (even) SEQ ID NO is encoded by the polynucleotide of immediately preceding (odd) SEQ ID NO. Hence, the KRED polypeptide of SEQ ID NO: 2 is encoded by the polynucleotide of SEQ ID NO: 1.

In a more preferred aspect, the present invention is directed to a KRED polypeptide that has from 5 to about 25 times more ketoreductase activity than the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 24. | E9K, S42N, D137N, D143N, A194V, K238R | SEQ ID NO: 484 |
| 25. | E9K, S42N, V147A, A194V, K238R | SEQ ID NO: 486 |
| 26. | E9K, S42N, S66R, A194V, F201L, K238R | SEQ ID NO: 488 |
| 27. | S42N, A194V, K238E | SEQ ID NO: 490 |
| 28. | S42N, V147A, A194V, K238R | SEQ ID NO: 498 |
| 29. | P14A, S42N, A194V | SEQ ID NO: 502 |
| 30. | P14A, S42N, T190A, A194V | SEQ ID NO: 506 |
| 31. | E9K S42N D137N D143N V147A A194V K238R | SEQ ID NO: 508 |
| 32. | P14A, S42N, V147A, A194V, I275V | SEQ ID NO: 512 |
| 33. | S42N, V147A, A194V, K238R | SEQ ID NO: 514 |
| 34. | P14A, S42N, G71D, V147A A194V K238R | SEQ ID NO: 516 |
| 35. | P14A S42N V147A A194V K238R I275V | SEQ ID NO: 518 |
| 36. | P14A N20D S42N V147A A194V I275V | SEQ ID NO: 520 |
| 37. | P14A S42N T190A A194V | SEQ ID NO: 522 |
| 38. | P14A S42N V147AA194V I275V | SEQ ID NO: 524 |
| 39. | P14A S42N V147A A194V K238R | SEQ ID NO: 526 |
| 40. | N7K P14A S42N V147A A194V I275V | SEQ ID NO: 528 |
| 41. | P14A S42N V147A A194V | SEQ ID NO: 530 |
| 42. | P14A N32S S42N V147A A194V K238R | SEQ ID NO: 532 |
| 43. | P14A S42N V147A A194V I275V | SEQ ID NO: 534 |
| 44. | E9G P14A N20S S42N T190A A194V E234G | SEQ ID NO: 536 |
| 45. | E9G P14A S42N T190A A194V | SEQ ID NO: 538 |
| 46. | P14A S42N A194V I275V | SEQ ID NO: 540 |
| 47. | E9G P14A S42N T190A | SEQ ID NO: 542 |

In an even more preferred aspect, the present invention, is directed to a KRED polypeptide that has from 9 to about 25 times more ketoreductase activity than the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 35. | P14A S42N V147A A194V K238R I275V | SEQ ID NO: 518 |
| 36. | P14A N20D S42N V147A A194V I275V | SEQ ID NO: 520 |
| 39. | P14A S42N V147A A194V K238R | SEQ ID NO: 526 |
| 40. | N7K P14A S42N V147A A194V I275V | SEQ ID NO: 528 |
| 44. | E9G P14A N20S S42N T190A A194V E234G | SEQ ID NO: 536 |
| 45. | E9G P14A S42N T190A A194V | SEQ ID NO: 538 |
| 46. | P14A S42N A194V I275V | SEQ ID NO: 540 |

In a most preferred aspect, the present invention, is directed to a KRED polypeptide that has from 13 to about 25 times more ketoreductase activity than the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 44. | E9G P14A N20S S42N T190A A194V E234G | SEQ ID NO: 536 |
| 45. | E9G P14A S42N T190A A194V | SEQ ID NO: 538 |

In another aspect, the present invention is directed to a KRED polypeptide having 1.5 to about 25 times the ketoreductase activity of the polypeptide of SEQ ID NO: 2, and either (a) having an amino acid sequence which has at least 90% homology, preferably at least 95% homology, and more preferably at least 97%, and most preferably at least 99% homology with the amino acid sequence of SEQ ID NO: 224, 244, 246, 250, 252, 254, 256, 260, 304, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540 or 542 (hereinafter "homologous polypeptides");

(b) is encoded by a nucleic acid sequence which hybridizes under medium stringency conditions with either (i) the nucleotide sequence of SEQ ID NO: 223, 243, 245, 249, 251, 253, 255, 259, 303, 343, 353, 357, 359, 363, 367, 373, 381, 385, 387, 399, 407, 437, 439, 447, 469, 483, 485, 487, 489, 501, 505, 507, 511, 513, 515, 517, 519, 521, 523, 525, 527, 529, 531, 533, 535, 537, 539 or 541, (ii) a subsequence of (i) of at least 100 nucleotides, or (iii) a complementary strand of (i) or (ii) (See e.g., J. Sambrook, E. F. Fritsch, and T. Maniatis, 1989, Molecular Cloning, A Laboratory Manual, 2d edition, Cold Spring Harbor, N.Y.);

(c) is a variant of the polypeptide of SEQ ID NO: 224, 244, 246, 250, 252, 254, 256, 260, 303, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540 or 542 comprising a substitution, deletion, and/or insertion of one to six amino acids;

(d) is a fragment of at least 220 amino acid residues from a polypeptide of SEQ ID NO: 224, 244, 246, 250, 252, 254, 256, 260, 303, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540, or 542; or (e) is a polypeptide of (a), (b), (c) or (d) that retains more than 60% of the initial KRED activity after incubation at 50° C., pH 7 for 60 minutes.

The novel KRED polypeptides of the present invention also have enhanced thermostability relative to the wild-type ketoreductase (SEQ ID NO: 2). Thermostability was determined as a percentage of initial (untreated) KRED activity (e.g., Example 4) remaining after heat treatment of the cell lysates to 50° C. for 20 to 24 hours (hereinafter "heat treatment"). As a basis for comparison, the backbone KRED polypeptide (CR2-5) of SEQ ID NO: 2 retained 10% of its initial KRED activity after heat treatment. Thus, after heat treatment, any KRED polypeptide that exhibited a KRED activity that exceeded 20% of its pretreatment activity was considered to have enhanced thermostability. Preferably, the KRED activity remaining after heat treatment of a KRED polypeptide of the present invention was at least 50% activity (i.e., at least 50% of the pretreatment activity), and most preferably at least 100% activity (activity before and after heat treatment were equivalent). Table 1 lists the "activity" for the variant KRED polypeptides of the present invention relative to the KRED activity of CR2-5, which is the wild-type KRED polypeptide of (SEQ ID NO: 2). It also lists the thermostability for various KRED polypeptides of the present invention after heat treatment of their respective cell lysates at 50° C. for 20 to 24 hours.

Thus, based upon a combination of enhanced thermostability and enhanced KRED activity, a preferred KRED polypeptide of the present invention has SEQ ID NO: 92, 98, 264, 268, 270, 276, 288, 294, 300, 302, 304, 310, 318, 324, 328, 332, 334, 344, 506 526 or 542. Also within the scope of the present invention is a polynucleotide that encodes a KRED polypeptide of SEQ ID NO: 92, 98, 264, 268, 270, 276, 288, 294, 300, 302, 304, 310, 318, 324, 328, 332, 334, 344, 506, 526 or 542, such as a polynucleotide of SEQ ID NO: 91, 97, 263, 267, 269, 275, 287, 293, 299, 301, 303, 309, 317, 323, 327, 331, 333, 505, 525 or 541, respectively, or a codon optimized version thereof.

In another embodiment based upon enhanced KRED activity, a preferred KRED polypeptide of the present invention has at least 151% of the KRED activity of SEQ ID NO: 2, and has the amino acid sequence of SEQ ID NO: 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 344, 332, 334, 336, 338, 340, 342, 354, 358, 360, 364, 368, 374, 382, 386, 388, 398, 400, 408, 438, 440, 448, 470, 484, 486, 488, 490, 502, 506, 508, 512, 514, 516, 518, 520, 522, 524, 526, 528, 530, 532, 534, 536, 538, 540 or 542. A more preferred KRED polypeptide of the present invention has at least 500% the KRED activity of SEQ ID NO: 2 and has the amino acid sequence of SEQ ID NO: 484, 486, 488, 490, 502, 506, 508, 512, 514, 516, 518, 520, 522, 524, 526, 528, 530, 532, 534, 536, 538, 540 or 542. Correspondingly, the present invention is also directed to a polynucleotide which encodes a KRED polypeptide of SEQ ID NO: 484, 486, 488, 490, 502, 506, 508, 512, 514, 516, 518, 520, 522, 524, 526, 528, 530, 532, 534, 536, 538, 540, or 542 such as a polynucleotide of SEQ ID NO: 483, 485, 487, 489, 501, 505, 507, 511, 513, 515, 517, 519, 521, 523, 525, 527, 529, 531, 533, 535, 537, 539, or 541 respectively.

The various residue positions of the KRED polypeptide (source *Candida magnoliae*) of SEQ ID NO: 2 that have been substituted to yield enhanced KRED activity and/or thermostability are summarized in Table 4 herein. The amino acid sequences for a number of the inventive KRED polypeptides that have demonstrated enhanced KRED activity and/or thermostability at 50° C. are disclosed herein as SEQ ID NOS: 42, 44, 46, 48, 50, 52, 54, 56, 58, 60, 62, 64, 66, 68, 70, 72, 74, 76, 78, 80, 82, 84, 86, 88, 90, 92, 94, 96, 98, 124, 206, 224, 226, 244, 246, 250, 252, 254, 256, 260, 344, 354, 358, 360, 364, 368, 374, 382, 386, 388, 398, 400, 408, 438, 440, 448, 470, 484, 486, 488, 490, 502, 506, 508, 512, 514, 516, 518, 520, 522, 524, 526, 528, 530, 532, 534, 536, 538, 540, or 542.

In a second aspect, the present invention is directed to any polynucleotide sequence encoding one of the above described inventive KRED polypeptides, such as a polynucleotide of SEQ ID NO: 41, 43, 45, 47, 49, 51, 53, 55, 57, 59, 61, 63, 65, 67, 69, 71, 75, 77, 79, 81, 83, 85, 87, 89, 91, 93, 95, 97, 123, 205, 223, 225, 243, 245, 249, 251, 253, 255, 259, 261, 263, 265 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 343, 331, 333, 335, 337, 339, 341, 343, 353, 357, 359, 363, 367, 373, 381, 385, 387, 397, 399, 407, 437, 439, 447, 469, 483, 485, 487, 489, 501, 505, 507, 511, 513, 515, 517, 519, 521, 523, 525, 527, 529, 531, 533, 535, 537, 539, or 541 respectively.

In a preferred embodiment, the present invention is directed to a polynucleotide of SEQ ID NO: 223, 243, 245, 249, 251, 253, 255, 259, 303, 343, 353, 357, 359, 363, 367, 373, 381, 385, 387, 399, 407, 437, 439, 447, 469, 483, 485, 487, 489, 501, 505, 507, 511, 513, 515, 517, 519, 521, 523, 525, 527, 529, 531, 533, 535, 537, 539, or 541 that encodes a novel KRED polypeptide of SEQ ID NOS: 224, 244, 246, 250, 252, 254, 256, 260, 304, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540, or 542, respectively.

In a more preferred embodiment, the present invention is directed to a polynucleotide of SEQ ID NO: 483, 485, 487, 489, 501, 505, 507, 511, 513 or 525 that encodes a KRED polypeptide of SEQ ID NO: 484, 486, 488, 490, 502, 506, 508, 512, 514, or 526, respectively.

In an even more preferred embodiment, the present invention is directed to a polynucleotide of SEQ ID NO: 505, 519, 525, 535, and 537 that encodes a KRED polypeptide of SEQ ID NO: 506, 520, 526, 536, and 538, respectively.

In a third aspect, the present invention is directed to a nucleic acid construct, a vector, or a host cell comprising a polynucleotide sequence encoding a KRED polypeptide of the present invention operatively linked to a promoter.

In a fourth aspect, the present invention is directed to a method of making a KRED polypeptide of the present invention comprising (a) cultivating a host cell comprising a nucleic acid construct comprising a nucleic acid sequence encoding a KRED polypeptide of the present invention under conditions suitable for production of the polypeptide; and (b) recovering the polypeptide.

BRIEF DESCRIPTION OF SEVERAL VIEWS OF THE DRAWINGS

FIGS. 2A through 2H, in combination, provide a table comparing the % amino acid identity of the KRED polypeptides of the present invention, identified by their SEQ ID NOS, versus the KRED polypeptides of the five indicated prior art references (rows 1-5 of FIG. 2A). The amino acid sequence of the first prior art reference (WO200155342) is provided as SEQ ID NO: 2 (CR2-05). To generate FIGS. 2A-2H, alignments were done using a dynamic programming algorithm for Global Alignment Scoring Matrix: PAM 120 matrix with gap penalties for introducing gap=−22.183 and extending gap=−1.396. The percent identity=number of identical residues between the first sequence and the second sequence divided by the length of first sequence in alignment (with gaps)(p) indicates partial match. See Needleman, S. B. & Wunsch, C. D., "A general method applicable to the search for similarities in the amino acid sequence of two proteins," Journal of Molecular Biology, 48:443-453 (1970).

Figure 3:
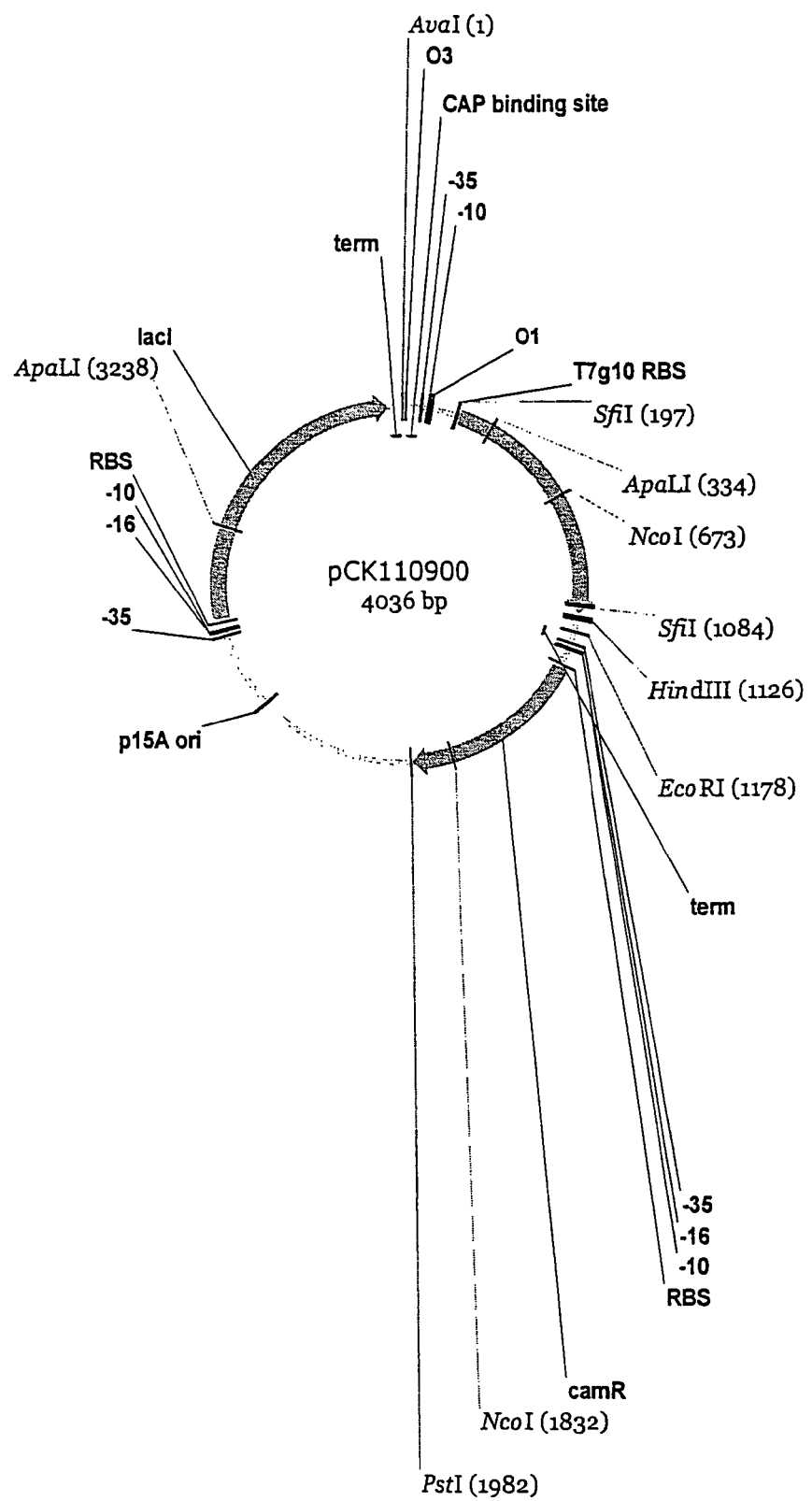

FIG. 3 is a 4036 bp expression vector (pCK110900) of the present invention comprising a P15A origin of replication (P15A ori), lac, a CAP binding site, a lac promoter, a T7 ribosomal binding site (T7g10 RBS), and a chloramphenicol resistance gene (camR).

The foregoing summary, as well as the following detailed description of certain embodiments of the present invention, will be better understood when read in conjunction with the appended drawings. For the purpose of illustrating the invention, there is shown in the drawings, certain embodiments. It should be understood, however, that the present invention is not limited to the arrangements and instrumentality shown in the attached drawings.

DETAILED DESCRIPTION OF THE INVENTION

As used herein, the terms "ketoreductase" and "KRED" are used interchangeably herein to refer to a polypeptide that has the ability to catalyze the reduction of a ketone, preferably a ketone in a β-keto acid to the corresponding β-hydroxy acid in a stereospecific manner, utilizing reduced nicotinamide adenine dinucleotide (NADH) or reduced nicotinamide adenine dinucleotide phosphate (NADPH) as the reducing agent.

The present invention has multiple aspects. In one aspect, the present invention is directed to a ketoreductase ("KRED") polypeptide having enhanced KRED activity relative to a KRED of SEQ ID NO: 2, preferably having at least 1.5 times, typically, 1.5 to 50 times, more typically 1.5 to about 25 times the KRED activity of SEQ ID NO: 2 as measured by the decrease in absorbance or fluorescence of NADPH due to its oxidation with the concomitant reduction of a ketone to the corresponding alcohol. In another aspect, the present invention is directed to a KRED polypeptide having 1.5 to about 25 times the KRED activity of the polypeptide of SEQ ID NO: 2, such as measured by the decrease in absorbance or fluorescence of NADPH (e.g., Example 4) or by product produced in a coupled assay (e.g., Example 5), and being at least 90% homologous, preferably at least 95%, more preferably at least 97% and most preferably at least 99% homologous with the amino acid sequence of SEQ ID NO: 506, 520, 526, 536, and 538.

In one embodiment, the present invention is also directed to a variant KRED polypeptide, as described anywhere herein, in isolated and purified form. In another embodiment, the present invention is directed to a variant KRED polypeptide as described herein in lyophilized form. In yet another embodiment, the present invention is directed to a composition comprising a variant KRED polypeptide as described herein and a suitable carrier, typically a buffer solution, more typically a buffer solution having a pH between 6.0 and 8.0.

In another aspect, the present invention is directed to a KRED polypeptide (preferably, isolated and purified) having at least 1.5 times, typically, 1.5 to 50 times, more typically 1.5 to about 25 times the KRED activity of the polypeptide of SEQ ID NO: 2, and having the amino acid sequence of SEQ ID NO: 2 with one to twenty, preferably one to seven, of the following residue changes: A2V; K3E; F5L or C; N7K; E9G or K; A12V; P13L; P14A; A16G or V; T18A; K19I; N20D or S; E21K; S22N or T; Q24H or R; V25A; N32S or D; A36T; S41G; S42N; I45L; A48T; V56A; V60I; Y64H; N65K, D, Y or S; S66G or R; H67L or Q; D68G or N; G71D; E74K or G; K78R; K79R; K85R; A86V; N90D; S93Nor C; D95N, G, V, Y or E; K98R; Q99L, R, or H; T100A; I101V; Q103R; I105V or T; K106R or Q; H110Y, C or R; V114A; A116G; I120V; K124R; D129G or N; D131G or V; D132N; K134M, V, E or R; D137N or G; Q138L; V140I; D143N; L144F; K145R; V147A; V150A; H153Y or Q; H157Y; F158L or Y; R159K; E160G or V; F162Y or S; E163G or K; E165D, G or K; K167I or R; A170S; V172I; F173C; M177V or T; H180Y; V184I; T190A; A193V; A194V; F201L; K203R; F209Y; V218I; N224S; E226K, G or D; S228T; D229A; V231I or A; Q233K or R; E234G or D; T235K or A; N237Y; K238R or E; T251A; V255A; F260L; A262V; T272A; I274L; I275L or V; and P283R.

Except as otherwise noted, the terms "percent identity," "% identity," "percent identical," and "% identical" are used interchangeably herein to refer to the percent amino acid sequence identity that is determined using the Needleman Wunsch global alignment algorithm, i.e., using dynamic programming algorithm for Global Alignment Scoring Matrix: PAM 120 matrix with gap penalties for introducing gap=−22.183 and extending gap=−1.396; the percent identity=number of identical residues between the first sequence and the second sequence divided by the length of first sequence in alignment (with gaps) (p) indicates partial match. See Needleman, S. B. & Wunsch, C. D., "A general method applicable to the search for similarities in the amino acid sequence of two proteins," Journal of Molecular Biology, 48:443-453 (1970).

Figure 1:
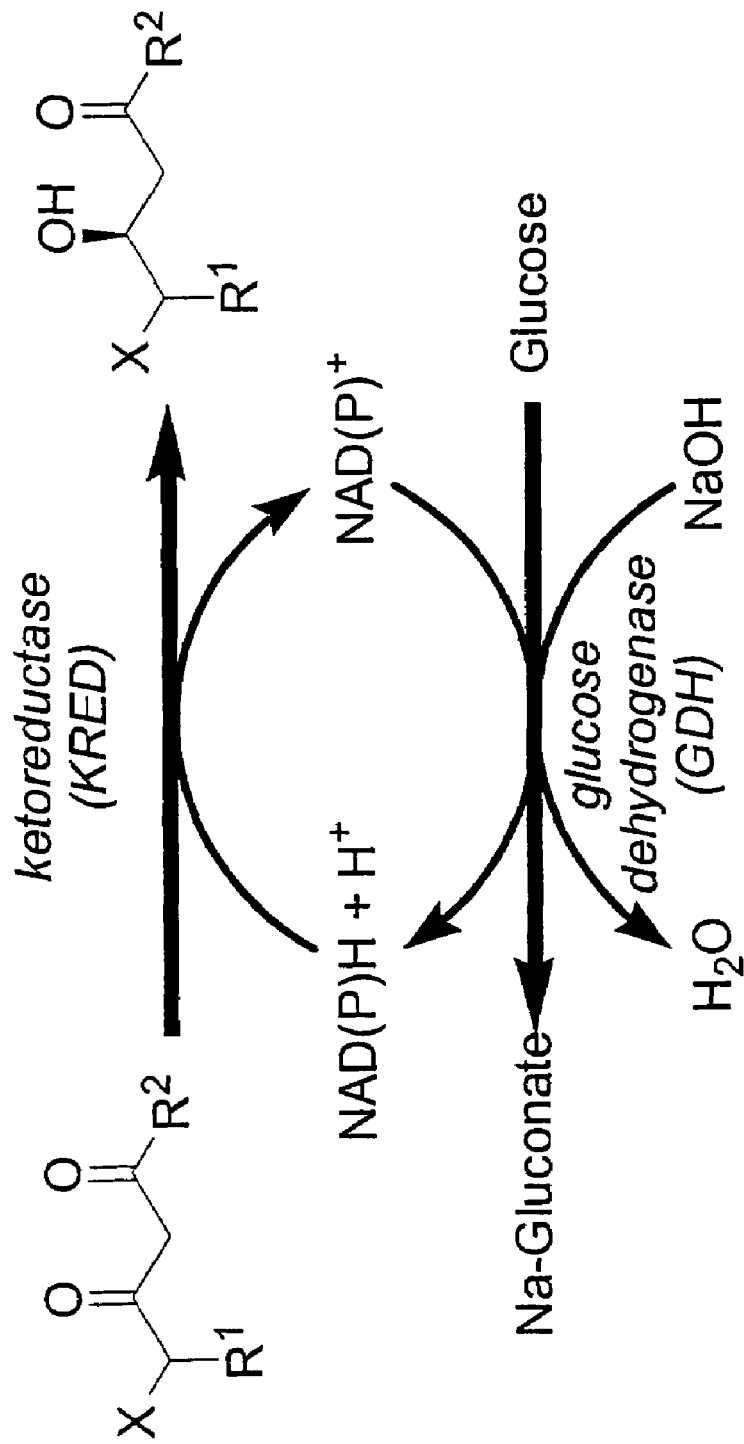
FIG. 1 exemplifies an oxidation-reduction cycle wherein a ketoreductase reduces a β-ketone in the presence of the reducing agent NADPH to the corresponding β-hydroxy derivative and NADP, and wherein a glucose dehydrogenase (GDH) reduces the NADP back to NADPH in the presence of glucose which is oxidized to gluconic acid. The gluconic acid formed in this reaction is neutralized by sodium hydroxide to sodium-gluconate.

In use, the enhanced KRED polypeptides of the present invention are preferably coupled to a cofactor regeneration system that provides a continuing source of cofactor for the KRED polypeptide. See FIG. 1. As used herein, the term "cofactor" refers to a non-protein compound that operates synergistically with an enzyme to catalyze a reaction of interest. For example, the cofactors, NADH or NADPH, are utilized with an enzyme, such as the KRED polypeptides of the present invention, and a cofactor regeneration system, such as glucose dehydrogenase/glucose, to catalyze the stereospecific reduction of 3-keto-butyric acid ester/amide to their corresponding 3-hydroxybutyric acid ester/amide, and α-haloketones, to their corresponding halohydrins.

The term "cofactor regeneration system" refers herein to a set of reactants that participate in a reaction that regenerates a utilized cofactor back to its pre-reaction state. An example is the regeneration of oxidized cofactor NAD or NADP back to the reduced form of the cofactor, e.g., NADH and NADPH, respectively. The reduced (regenerated) cofactor is then capable of again reacting again with a substrate and an enzyme, such as a ketoreductase, to produce the stereospecifically reduced substrate and the oxidized (utilized) cofactor, wherein the latter is regenerated by the cofactor regeneration system. Suitable cofactor regeneration systems include glucose and glucose dehydrogenase, formate dehydrogenase and formate, glucose-6-phosphate dehydrogenase and glucose-6-phosphate, secondary alcohol dehydrogenase and isopropyl alcohol, and the like, all of which are used with either NADP/NADPH or NAD/NADH. Thus, for example, when 4-halo-3-keto-butyric acid ester or amide is reduced by a KRED polypeptide of the invention and NADPH (or NADH) to produce the desired hydroxy compound and NADP (or NAD), the resulting NADP (or NAD) is reduced back (regenerated) to its original form, NADPH (or NADH), by glucose and a catalytic amount of glucose dehydrogenase acting as a cofactor regeneration system. The above-described operation of the glucose dehydrogenation cofactor regeneration system is exemplified in FIG. 1.

The term "coupled" is used herein to refer to the use of the reduced form of cofactor in the reduction of the ketoreductase substrate, and the concomitant use of the oxidized form of the same cofactor, generated in the aforementioned reaction, in the oxidation of a component (e.g., glucose) of the cofactor regeneration system, which generates the reduced form of the same cofactor. Thus, in FIG. 1, the ketoreductase enzyme is shown as being coupled to the glucose dehydrogenase cofactor regeneration system.

In a preferred aspect of the above embodiment, the present invention is directed to a KRED polypeptide that has from 1.5 to about 25 times the KRED activity of the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 1. | S42N | SEQ ID NO: 224 |
| 2. | S42N, K124R, A194V | SEQ ID NO: 244 |
| 3. | S42N, A194V, K203R | SEQ ID NO: 246 |
| 4. | S42N, E160G, A194V | SEQ ID NO: 250 |
| 5. | S42N, D95Y | SEQ ID NO: 252 |
| 6. | S42N, A194V | SEQ ID NO: 254 |
| 7. | S42N, V140I, F158L, M177T, V184I | SEQ ID NO: 256 |
| 8. | H67Q, F158Y, T235K | SEQ ID NO: 260 |
| 9. | S42N, A194V, T235K | SEQ ID NO: 354 |
| 10. | E21K, S42N, K78R, A194V | SEQ ID NO: 358 |
| 11. | S42N, E163K, A194V | SEQ ID NO: 360 |
| 12. | S42N, V184I, A194V, T235K | SEQ ID NO: 364 |
| 13. | N7K, S42N, A194V | SEQ ID NO: 368 |
| 14. | S42N, D129N, A194V | SEQ ID NO: 374 |
| 15. | E9K, S42N, A194V | SEQ ID NO: 382 |
| 16. | S42N, D131G, A194V | SEQ ID NO: 386 |
| 17. | S42N, D131V, A194V | SEQ ID NO: 388 |
| 18. | S42N, D131G, A194V, T235K | SEQ ID NO: 400 |
| 19. | S42N, Q103R, A194V | SEQ ID NO: 408 |
| 20. | E9K, S42N, A194V, K238R | SEQ ID NO: 438 |
| 21. | S42N, VI84I, A194V | SEQ ID NO: 440 |
| 22. | E9K, S42N, N90D, A194V | SEQ ID NO: 448 |
| 23. | E9K, S42N, D131G, A194V, Q233R | SEQ ID NO: 470 |
| 24. | E9K, S42N, D137N, D143N, A194V, K238R | SEQ ID NO: 484 |
| 25. | E9K, S42N, V147A, A194V, K238R | SEQ ID NO: 486 |
| 26. | E9K, S42N, S66R, A194V, F201L, K238R | SEQ ID NO: 488 |
| 27. | S42N, A194V, K238E | SEQ ID NO: 490 |
| 28. | S42N, V147A, A194V, K238R | SEQ ID NO: 498 |
| 29. | P14A, S42N, A194V | SEQ ID NO: 502 |
| 30. | P14A, S42N, T190A, A194V | SEQ ID NO: 506 |
| 31. | E9K S42N D137N D143N V147A A194V K238R | SEQ ID NO: 508 |
| 32. | P14A, S42N, V147A, A194V, I275V | SEQ ID NO: 512 |
| 33. | S42N, V147A, A194V, K238R | SEQ ID NO: 514 |
| 34. | P14A, S42N, G71D, V147A A194V K238R | SEQ ID NO: 516 |
| 35. | P14A S42N V147A A194V K238R I275V | SEQ ID NO: 518 |
| 36. | P14A N20D S42N V147A A194V I275V | SEQ ID NO: 520 |
| 37. | P14A S42N T190A A194V | SEQ ID NO: 522 |
| 38. | P14A S42N V147A, A194V I275V | SEQ ID NO: 524 |
| 39. | P14A S42N V147A A194V K238R | SEQ ID NO: 526 |
| 40. | N7K P14A S42N V147A A194V I275V | SEQ ID NO: 528 |
| 41. | P14A S42N V147A A194V | SEQ ID NO: 530 |
| 42. | P14A N32S S42N V147A A194V K238R | SEQ ID NO: 532 |
| 43. | P14A S42N V147A A194V I275V | SEQ ID NO: 534 |
| 44. | E9G P14A N20S S42N T190A A194V E234G | SEQ ID NO: 536 |
| 45. | E9G P14A S42N T190A A194V | SEQ ID NO: 538 |
| 46. | P14A S42N A194V I275V | SEQ ID NO: 540 |
| 47. | E9G P14A S42N T190A | SEQ ID NO: 542 |

In a more preferred aspect, the present invention is directed to a KRED polypeptide that has from 5 to about 25 times more ketoreductase activity than the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 24. | E9K, S42N, D137N, D143N, A194V, K238R | SEQ ID NO: 484 |
| 25. | E9K, S42N, V147A, A194V, K238R | SEQ ID NO: 486 |
| 26. | E9K, S42N, S66R, A194V, F201L, K238R | SEQ ID NO: 488 |
| 27. | S42N, A194V, K238E | SEQ ID NO: 490 |
| 28. | S42N, V147A, A194V, K238R | SEQ ID NO: 498 |
| 29. | P14A, S42N, A194V | SEQ ID NO: 502 |
| 30. | P14A, S42N, T190A, A194V | SEQ ID NO: 506 |
| 31. | E9K S42N D137N D143N V147A A194V K238R | SEQ ID NO: 508 |
| 32. | P14A, S42N, V147A, A194V, I275V | SEQ ID NO: 512 |
| 33. | S42N, V147A, A194V, K238R | SEQ ID NO: 514 |
| 34. | P14A, S42N, G71D, V147A A194V K238R | SEQ ID NO: 516 |
| 35. | P14A S42N V147A A194V K238R I275V | SEQ ID NO: 518 |
| 36. | P14A N20D S42N V147A A194V I275V | SEQ ID NO: 520 |
| 37. | P14A S42N T190A A194V | SEQ ID NO: 522 |
| 38. | P14A S42N V147A, A194V I275V | SEQ ID NO: 524 |
| 39. | P14A S42N V147A A194V K238R | SEQ ID NO: 526 |
| 40. | N7K P14A S42N V147A A194V I275V | SEQ ID NO: 528 |
| 41. | P14A S42N V147A A194V | SEQ ID NO: 530 |
| 42. | P14A N32S S42N V147A A194V K238R | SEQ ID NO: 532 |
| 43. | P14A S42N V147A A194V I275V | SEQ ID NO: 534 |
| 44. | E9G P14A N20S S42N T190A A194V E234G | SEQ ID NO: 536 |
| 45. | E9G P14A S42N T190A A194V | SEQ ID NO: 538 |
| 46. | P14A S42N A194V I275V | SEQ ID NO: 540 |
| 47. | E9G P14A S42N T190A | SEQ ID NO: 542 |

In an even more preferred aspect, the present invention, is directed to a KRED polypeptide that has from 9 to about 25 times more ketoreductase activity than the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 35. | P14A S42N V147A A194V K238R I275V | SEQ ID NO: 518 |
| 36. | P14A N20D S42N V147A A194V I275V | SEQ ID NO: 520 |
| 39. | P14A S42N V147A A194V K238R | SEQ ID NO: 526 |
| 40. | N7K P14A S42N V147A A194V I275V | SEQ ID NO: 528 |
| 44. | E9G P14A N20S S42N T190A A194V E234G | SEQ ID NO: 536 |
| 45. | E9G P14A S42N T190A A194V | SEQ ID NO: 538 |
| 46. | P14A S42N A194V I275V | SEQ ID NO: 540 |

In a most preferred aspect, the present invention, is directed to a KRED polypeptide that has from 13 to about 25 times more ketoreductase activity than the polypeptide of SEQ ID NO: 2, when measured as the lysate, but that differs from the polypeptide of SEQ ID NO: 2 by having one of the following sets of amino acid substitutions and by having the corresponding SEQ ID NO:

| | | |
|---|---|---|
| 44. | E9G P14A N20S S42N T190A A194V E234G | SEQ IN NO: 536 |
| 45. | E9G P14A S42N T190A A194V | SEQ IN NO: 538 |

The KRED polypeptides of the present invention have enhanced KRED activity (such as measured by the method of Example 4) that is 1.5 fold to about 25 fold greater than the KRED activity of the backbone KRED polypeptide from *C. magnoliae* of SEQ ID NO: 2, and vary from SEQ ID NO: 2 by 1-20 amino acid residues, typically by 1-10 amino acid residues, more typically by 1-9 amino acid residues, even more typically by 1-8 amino acid residues, and most typically by 1-7 amino acid residues. Preferably, the KRED polypeptides of the present invention have enhanced KRED activity that is 9 fold to about 25 fold greater, more preferably, 13 to about 25 fold greater than the KRED activity of the backbone KRED polypeptide of SEQ ID NO: 2.

In another aspect, the present invention is directed to a KRED polypeptide having 1.5 to about 25 times the ketoreductase activity of the polypeptide of SEQ ID NO: 2, and either (a) having an amino acid sequence which has at least 90% homology, preferably at least 95% homology, and more preferably at least 97%, and most preferably at least 99% homology with an amino acid sequence of SEQ ID NO: 224, 244, 246, 250, 252, 254, 256, 260, 304, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540, or 542 (hereinafter "homologous polypeptides");

(b) is encoded by a nucleic acid sequence which hybridizes under medium stringency conditions with either (i) the nucleotide sequence of SEQ ID NO: 223, 243, 245, 249, 251, 253, 255, 259, 303, 343, 353, 357, 359, 363, 367, 373, 381, 385, 387, 399, 407, 437, 439, 447, 469, 483, 485, 487, 489, 501, 505, 507, 511, 513, 515, 517, 519, 521, 523, 525, 527, 529, 531, 533, 535, 537, 539 or 541, (ii) a subsequence of (i) of at least 100 nucleotides, or (iii) a complementary strand of (i) or (ii) (See e.g., J. Sambrook, E. F. Fritsch, and T. Maniatis, 1989, Molecular Cloning, A Laboratory Manual, 2d edition, Cold Spring Harbor, N.Y.);

(c) is a variant of the polypeptide of SEQ ID NO: 224, 244, 246, 250, 252, 254, 256, 260, 303, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540, or 542 comprising a substitution, deletion, and/or insertion of one to six amino acids;

(d) is a fragment of at least 220 amino acid residues from a polypeptide of SEQ ID NO: 224, 244, 246, 250, 252, 254, 256, 260, 303, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540, or 542; or (e) is a polypeptide of (a), (b), (c) or (d) that retains more than 60% of the initial KRED activity after incubation at 50° C., pH 7 for 60 minutes.

The novel KRED polypeptides of the present invention also have enhanced thermostability relative to the wild-type ketoreductase of SEQ ID NO: 2. Thermostability was determined as a percentage of initial (untreated) KRED activity (e.g., Example 4) remaining after heat treatment of the cell lysates to 50° C. at pH 7 for 20 to 24 hours (hereinafter "heat treatment"). As a basis for comparison, the wild-type KRED polypeptide (CR2-5) of SEQ ID NO: 2 retained 10% of its initial KRED activity after heat treatment. Thus, after heat treatment, any KRED polypeptides that exhibited a KRED activity that exceeded 20% of its pretreatment activity were considered to have enhanced thermostability. Preferably, the KRED activity after heat treatment of a variant KRED polypeptide of the present invention was at least 50% activity remaining, and most preferably at least 100% activity remaining. Table 1 lists the "% activity" for the variant KRED polypeptides of the present invention relative to the KRED activity of CR2-5 which is the wild-type KRED polypeptide of (SEQ ID NO: 2). It also lists the thermostability for various KRED polypeptides of the present invention after heat treatment of their respective cell lysates at 50° C. for 20-24 hours.

TABLE 1

| SEQ ID NO: | Amino Acid Mutations | % Activity over control | Thermostability after heat treatment |
|---|---|---|---|
| 76 | H67Q F158Y | * | − |
| 124 | H67Q V140I F158Y K167I V172I M177V V184I | * | − |
| 224 | S42N | * | − |
| 254 | S42N A194V | * | + |
| 344 | S42N A194V | * | + |
| 354 | S42N A194V T235K | * | − |
| 440 | S42N V184I A194V | * | + |
| 470 | E9K S42N D131G A194V Q233R | * | − |
| 486 | E9K S42N V147A A194V K238R | ** | − |
| 506 | P14A S42N T190A A194V | ** | ++ |
| 520 | P14A N20D S42N V147A A194V I275V | *** | − |
| 526 | P14A S42N V147A A194V K238R | *** | ++ |
| 536 | E9G P14A N20S S42N T190A A194V E234G | **** | − |
| 538 | E9G P14A S42N T190A A194V | **** | − |
| 540 | P14A S42N A194V I275V | **** | − |
| 542 | E9G P14A S42N T190A | ** | ++ |

Where * = 150-500% activity of SEQ ID NO: 2
** = 500-900% activity of SEQ ID NO: 2
*** = 900-1300% activity of SEQ ID NO: 2
**** = greater than 1300% activity of SEQ ID NO: 2
− = activity after heat treatment is less than 20% of untreated clone
+ = activity after heat treatment is 20-50% compared to untreated clone
++ = activity after heat treatment is 50-100% compared to untreated clone Thus, based upon a combination of enhanced thermostability and enhanced KRED activity, a preferred KRED polypeptide of the present invention has SEQ ID NO: 344, 440, 506, 526 or 542. Also within the scope of the present invention is a polynucleotide that encodes a KRED polypeptide of SEQ ID NO: 344, 440, 506, 526, or 542 such as a polynucleotide of SEQ ID NO: 343, 439, 505, 525, or 541 respectively, or a codon optimized version thereof.

In another embodiment based upon enhanced KRED activity, a preferred KRED polypeptide of the present invention has at least 151% of the KRED activity of SEQ ID NO: 2, and has the amino acid sequence of SEQ ID NO: 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 344, 332, 334, 336, 338, 340, 342, 354, 358, 360, 364, 368, 374, 382, 386, 388, 398, 400, 408, 438, 440, 448, 470, 484, 486, 488, 490, 502, 506, 508, 512, 514, 516, 518, 520, 522, 524, 526, 528, 530, 532, 534, 536, 538, 540, or 542. A more preferred KRED polypeptide of the present invention has at least 500% the KRED activity of SEQ ID NO: 2 and has the amino acid sequence of SEQ ID NO: 484, 486, 488, 490, 502, 506, 508, 512, 514, 516, 518, 520, 522, 524, 526, 528, 530, 532, 534, 536, 538, 540 or 542. Correspondingly, the present invention is also directed to a polynucleotide which encodes a KRED polypeptide of SEQ ID NO: 484, 486, 488, 490, 502, 506, 508, 512, 514, 516, 518, 520, 522, 524, 526, 528, 530, 532, 534, 536, 538, 540 or 542, such as a polynucleotide of SEQ ID NO: 483, 485, 487, 489, 501, 505, 507, 511, 513, 515, 517, 519, 521, 523, 525, 527, 529, 531, 533, 535, 537, 539 or 541, respectively.

A more preferred KRED polypeptide of the present invention has at least 900% the KRED activity of SEQ ID NO: 2 and has the amino acid sequence of SEQ ID NO: 518, 520, 526, 528, 536, 538, or 540.

An even more preferred KRED polypeptide of the present invention has greater than 1300% the KRED activity of SEQ ID NO: 2 and has SEQ ID NO: 536, 538 Typically, the above described KRED polypeptides of the present invention have less than 2500% the KRED activity, as measured as the lysate, than the KRED polypeptide of SEQ ID NO: 2. Also preferred are the polynucleotides which encode for the above referenced polypeptides and which polynucleotides have a SEQ ID NO: that is one integer lower than the respective polypeptide that it encodes.

In yet another aspect, the present invention is directed to KRED polypeptides that have enhanced activity in a coupled chemistry reaction.

In another embodiment, the present invention is directed to a KRED polypeptide that is encoded by a nucleic acid sequence which hybridizes under medium stringency conditions with either (i) a nucleotide sequence of SEQ ID NO: 223, 243, 245, 249, 251, 253, 255, 259, 303, 343, 353, 357, 359, 363, 367, 373, 381, 385, 387, 399, 407, 437, 439, 447, 469, 483, 485, 487, 489, 501, 505, 507, 511, 513, 515, 517, 519, 521, 523, 525, 527, 529, 531, 533, 535, 537 539, or 541; or (ii) a subsequence of (i) of at least 100 nucleotides, or (iii) a complementary strand of (i) or (ii) (J. Sambrook, E. F. Fritsch, and T. Maniatis, 1989, Molecular Cloning, A Laboratory Manual, 2d edition, Cold Spring Harbor, N.Y.).

For polynucleotides of at least 100 nucleotides in length, low to very high stringency conditions are defined as follows: prehybridization and hybridization at 42° C. in 5×SSPE, 0.3% SDS, 200 µg/ml sheared and denatured salmon sperm DNA, and either 25% formamide for low stringencies, 35% formamide for medium and medium-high stringencies, or 50% formamide for high and very high stringencies, following standard Southern blotting procedures. For polynucleotides of at least 100 nucleotides in length, the carrier material is finally washed three times each for 15 minutes using 2×SSC, 0.2% SDS at least at 50° C. (low stringency), at least at 55° C. (medium stringency), at least at 60° C. (medium-high stringency), at least at 65° C. (high stringency), and at least at 70° C. (very high stringency).

In another embodiment, the present invention is directed to a variant of the polypeptide of SEQ ID NO: 224, 244, 246, 250, 252, 254, 256, 260, 303, 344, 354, 358, 360, 364, 368, 374, 382, 386, 388, 400, 408, 438, 440, 448, 470, 484, 486, 488, 490, 502, 506, 508, 512, 514, 516, 518, 520, 522, 524, 526, 528, 530, 532, 534, 536, 538, 540, or 542 having a substitution, deletion, and/or insertion of one to six amino acids therefrom, and having from 1.5 to about 25 times the KRED activity of the wild-type KRED of SEQ ID NO: 2, such as determined by the method of Example 4. Preferably, amino acid changes are of a minor nature, that is conservative amino acid substitutions that do not significantly affect the folding and/or activity of the protein; small deletions, typically of one to six amino acids; small amino- or carboxyl-terminal extensions; a small linker peptide; or a small extension that facilitates purification by changing net charge or another function, such as a poly-histidine tract, an antigenic epitope or a binding domain.

Examples of conservative substitutions are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine, proline, cysteine and methionine). Amino acid substitutions, which do not generally alter the specific activity are known in the art and are described, for example, by H. Neurath and R. L. Hill, 1979, in, The Proteins, Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly as well as these in reverse.

In another embodiment, the present invention is directed to a fragment of (a), (b) or (c), as described above that has from 1.5 to about 25 times the KRED activity of the wild-type KRED of SEQ ID NO: 2, such as determined by the method of Example 4. By the term "fragment" is meant that the polypeptide has a deletion of 1 to 10 amino acid residues from the carboxy terminus, the amino terminus, or both. Preferably, the deletion is 1 to 10 residues from the carboxy terminus; more preferably, the deletion is 1 to 5 residues from the carboxy terminus.

In yet another embodiment, the present invention is directed to a KRED polypeptide of (a), (b) or (c), as described above in the Detailed Description, that retains more than 20% of the initial (pre-incubation) KRED activity after incubation for 20-24 hours at 50° C., pH 7. Preferably, the polypeptides of the invention retain at least 20% of their initial activity, more preferably at least 50% of their initial activity after incubation for 20-24 hours at 50° C., pH 7. The initial and remaining KRED activities on the pre- and post-heat treated lysate (as prepared in Example 3) are readily determined by an assay for KRED activity, such as described in Example 4 herein.

Polynucleotides

In its second aspect, the present invention is directed to a polynucleotide sequence that encodes for a KRED polypeptide of the present invention. Given the degeneracy of the genetic code, the present invention is also directed to any polynucleotide that encodes for a KRED polypeptide of SEQ ID NO: 42, 72, 76, 96, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 344, 332, 334, 336, 338, 340, 342, 354, 358, 360, 364, 368, 374, 382, 386, 388, 398, 400, 408, 438, 440, 448, 470, 484, 486, 488, 490, 502, 506, 508, 512, 514, 516, 518, 520, 522, 524, 526, 528, 530, 532, 534, 536, 538, 540 or 542.

In a preferred embodiment, the present invention is directed to a polynucleotide of SEQ ID NO: 41, 71, 75, 95, 261, 263, 265 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 343, 331, 333, 335, 337, 339, 341, 353, 357, 359, 363, 367, 373, 381, 385, 387, 397, 399, 407, 437, 439, 447, 469, 483, 485, 487, 489, 501, 505, 507, 511, 513, 515, 517, 519, 521, 523, 525, 527, 529, 531, 533, 535, 537, 539, or 541 that encodes a novel KRED polypeptide of SEQ ID NO: 42, 72, 76, 96, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 344, 332, 334, 336, 338, 340, 342, 354, 358, 360, 364, 368, 374, 382, 386, 388, 398, 400, 408, 438, 440, 448, 470, 484, 486, 488, 490, 502, 506, 508, 512, 514, 516, 518, 520, 522, 524, 526, 528, 530, 532, 534, 536, 538, 540, or 542, respectively.

In a particularly preferred embodiment, the present invention is directed to a polynucleotide of SEQ ID NO: 253 that encodes the polypeptide of SEQ ID NO: 254 and to the codon optimized polynucleotides of SEQ ID NO: 303 and SEQ ID NO: 343, which contain silent mutations that provide for the enhanced expression of the polypeptide of SEQ ID NO: 254 in E. coli. In particular, the codon optimization in going from SEQ ID NO: 253 to SEQ ID NO: 343 consisted of the following silent substitutions: A16T, G17C, C30T, T339A, C600T, T738C and T744C. These silent substitutions resulted in a 2.5-fold increase in expression of the KRED polypeptide as measured by its KRED activity (e.g., Example 4) from the cell lysate (e.g., Example 3).

To make the improved KRED polynucleotides and polypeptides of the present invention, one starts with one or more wild-type polynucleotides that encode a KRED polypeptide for use as a backbone. The term "wild-type" as applied to a polynucleotide means that the nucleic acid fragment does not comprise any mutations from the form isolated from nature. The term "wild-type" as applied to a polypeptide (or protein) means that the protein will be active at a level of activity found in nature and typically will comprise the amino acid sequence as found in nature. Thus, the term "wild type" or "parental sequence" indicates a starting or reference sequence prior to a manipulation of the invention.

Suitable sources of naturally occurring KRED, as a starting material to be improved, are readily identified by screening genomic libraries of organisms for the KRED activities described herein. See e.g., Example 4. Naturally occurring KRED enzymes are found in a wide range of bacteria and yeasts, such as, *Candida magnoliae* (Genbank Acc. No. JC7338; GI:11360538), *Candida parapsilosis* (Genbank Ac. No. BAA24528.1; GI:2815409), *Sporobolomyces salmicolor* (Genbank Acc. No. AF160799; GI 6539734). A particularly suitable source of KRED is *Candida magnoliae*. In the present invention, a parental polynucleotide sequence encoding the wild-type KRED polypeptide of *Candida magnoliae* was constructed from 60-mer oligomers based upon the known polypeptide sequence for KRED from *Candida magnoliae*, which is published as Genbank Acc. No. JC7338. The parental polynucleotide sequence, designated as CR2-5 (SEQ ID NO: 1), was codon optimized for expression in *E. coli* and thus differed substantially from the wild-type polynucleotide sequence. The codon-optimized polynucleotide was cloned into the SfiI cloning sites of the expression vector, pCK110900 (depicted in FIG. 3), under control of the lac promoter and lacI repressor gene. The expression vector also contained the P15A origin of replication and the chloramphenicol resistance gene. Several clones were found that expressed an active ketoreductase in *E. coli* W3110 and the genes were sequenced to confirm their DNA sequences. The sequence designated CR2-5 (SEQ ID NO: 1) was the parent sequence utilized as the starting point for all experiments and library construction.

Once a suitable starting material, such as the polynucleotide of SEQ ID NO: 1, has been identified, a non-naturally occurring and mutated and/or evolved enzyme, having unknown KRED activity is readily generated using any one of the well-known mutagenesis or directed evolution methods. See, e.g., Ling, et al., "Approaches to DNA mutagenesis: an overview," *Anal. Biochem.*, 254(2):157-78 (1997); Dale, et al., "Oligonucleotide-directed random mutagenesis using the phosphorothioate method," *Methods Mol. Biol.*, 57:369-74 (1996); Smith, "In vitro mutagenesis," *Ann. Rev. Genet.*, 19:423-462 (1985); Botstein, et al., "Strategies and applications of in vitro mutagenesis," *Science*, 229:1193-1201 (1985); Carter, "Site-directed mutagenesis," *Biochem. J.*, 237:1-7 (1986); Kramer, et al., "Point Mismatch Repair," *Cell*, 38:879-887 (1984); Wells, et al., "Cassette mutagenesis: an efficient method for generation of multiple mutations at defined sites," *Gene*, 34:315-323 (1985); Minshull, et al., "Protein evolution by molecular breeding," *Current Opinion in Chemical Biology*, 3:284-290 (1999); Christians, et al., "Directed evolution of thymidine kinase for AZT phosphorylation using DNA family shuffling," *Nature Biotechnology*, 17:259-264 (1999); Crameri, et al., "DNA shuffling of a family of genes from diverse species accelerates directed evolution," *Nature*, 391:288-291; Crameri, et al., "Molecular evolution of an arsenate detoxification pathway by DNA shuffling," *Nature Biotechnology*, 15:436-438 (1997); Zhang, et al., "Directed evolution of an effective fructosidase from a galactosidase by DNA shuffling and screening," *Proceedings of the National Academy of Sciences, U.S.A.*, 94:45-4-4509; Crameri, et al., "Improved green fluorescent protein by molecular evolution using DNA shuffling,' *Nature Biotechnology*, 14:315-319 (1996); Stemmer, "Rapid evolution of a protein in vitro by DNA shuffling," *Nature*, 370:389-391 (1994); Stemmer, "DNA shuffling by random fragmentation and reassembly: In vitro recombination for molecular evolution," *Proceedings of the National Academy of Sciences, U.S.A.*, 91:10747-10751 (1994); WO 95/22625; WO 97/0078; WO 97/35966; WO 98/27230; WO 00/42651; WO 01/75767 and U.S. Pat. No. 6,537,746 which issued to Arnold, et al. on Mar. 25, 2003 and is entitled "Method for creating polynucleotide and polypeptide sequences."

Any of these methods can be applied to generate KRED polynucleotides. To maximize any diversity, several of the above-described techniques can be used sequentially. Typically, a library of shuffled polynucleotides is created by one mutagenic or evolutionary technique and their expression products are screened to find the polypeptides having the highest KRED activity. In the present case, a polynucleotide having SEQ ID NO: 75 was the most promising candidate from a screened library using NADH as cofactor. However, to obtain better expression of the polynucleotide from the plasmid pCK110900 of FIG. 3, the polynucleotide of SEQ ID NO: 75 was resynthesized using oligomers that were codon optimized for expression in *E. coli*. The resulting codon optimized polynucleotide had the sequence of SEQ ID NO: 77.

Thereafter, a second mutagenic or evolutionary technique was applied to the codon-optimized polynucleotide of SEQ ID NO: 77 to create a second library which in turn was screened for KRED activity by the same technique. Screening the resulting clones resulted in the isolation of three clones, SEQ ID NOs: 123, 203 and 223, encoding the KRED polypeptides of SEQ ID NOS: 124, 204 and 224 respectively, having between 3.1 and 4.3 times the KRED activity of the wild-type polypeptide of SEQ ID NO: 2 using NADH (SEQ ID NO: 124) or NADPH (SEQ ID NOS: 204 and 224) as cofactor. The process of mutating and screening can be repeated as many times as needed, including the insertion of point mutations, to arrive at a polynucleotide that encodes a polypeptide with the desired activity, thermostability, and cofactor preference.

To obtain better expression of the polynucleotide of SEQ ID NO: 123 from the plasmid pCK110900 of FIG. 3, the polynucleotide of SEQ ID NO: 123 was reamplified using oligomers to replace nucleotides that may lead to RNA-hairpin loop formation at the SfiI site of the vector and the 5' end of the KRED mRNA. Specifically, oligos were designed to disrupt these potential stem loop structures by changing the 5'-SfiI site of the pCK110900 vector as well as replacing the AGC codon for serine at residue 6 of the encoded KRED polypeptide with the TCC codon which also coded for serine. The resulting codon optimized polynucleotide resulted in approximately two and one half (2.5) fold higher expression of the KRED polypeptide, as measured by KRED activity in the lysate of the transformed and cultured host cell.

Following the screening of a third round library using NADPH as cofactor, a polynucleotide having SEQ ID NO: 253 was the most promising candidate. However, to obtain better expression of the polynucleotide from the plasmid pCK110900 of FIG. 3, the polynucleotide of SEQ ID NO: 253 was further improved by applying evolutionary techniques and cloned in a vector in which the hairpin forming nucleotides had been removed as for SEQ ID NO: 123 above. The resulting codon optimized polynucleotides included the polynucleotides of SEQ ID NO: 303 and SEQ ID NO: 343.

Instead of applying shuffling or evolutionary techniques, the polynucleotides and oligonucleotides of the invention can be prepared by standard solid-phase methods, according to known synthetic methods. Typically, fragments of up to about 100 bases are individually synthesized, then joined (e.g., by enzymatic or chemical litigation methods, or polymerase mediated methods) to form essentially any desired continuous sequence. For example, polynucleotides and oligonucleotides of the invention can be prepared by chemical synthesis using, e.g., the classical phosphoramidite method described by Beaucage et al. (1981) Tetrahedron Letters 22:1859-69, or the method described by Matthes et al. (1984) EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be custom ordered from any of a variety of commercial sources, such as The Midland Certified Reagent Company, Midland, Tex., The Great American Gene Company, Ramona, Calif., ExpressGen Inc. Chicago, Ill., Operon Technologies Inc., Alameda, Calif., and many others.

Nucleic Acid Construct/Expression Cassette/Expression Vector

In another aspect, the present invention is directed to a nucleic acid construct comprising a polynucleotide encoding a KRED polypeptide of the present invention operatively linked to one or more heterologous regulatory sequences that control gene expression to create a nucleic acid construct, such as an expression vector or expression cassette. Thereafter, the resulting nucleic acid construct, such as an expression vector or expression cassette, was inserted into an appropriate host cell for ultimate expression of the KRED polypeptide encoded by the variant polynucleotide.

A "nucleic acid construct" is defined herein as a nucleic acid molecule, either single- or double-stranded, which is isolated from a naturally occurring gene or which has been modified to contain segments of nucleic acid combined and juxtaposed in a manner that would not otherwise exist in nature. The term nucleic acid construct is inclusive of the term expression cassette or expression vector when the nucleic acid construct contains all the control sequences required for expression of a coding sequence (polynucleotide) of the present invention.

The term "coding sequence" is defined herein as a polynucleotide sequence, which directly specifies the amino acid sequence of its protein product. The boundaries of a genomic coding sequence are generally determined by a ribosome binding site (prokaryotes) or by the ATG start codon (eukaryotes) located just upstream of the open reading frame at the 5' end of the mRNA and a transcription terminator sequence located just downstream of the open reading frame at the 3' end of the mRNA. A coding sequence can include, but is not limited to, DNA, cDNA, and recombinant nucleic acid sequences.

An isolated polynucleotide encoding a KRED polypeptide of the present invention may be manipulated in a variety of ways to provide for expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

The term "control sequence" is defined herein to include all components, which are necessary or advantageous for the expression of a polypeptide of the present invention. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

The term "operably linked" is defined herein as a configuration in which a control sequence is appropriately placed at a position relative to the coding sequence of the DNA sequence such that the control sequence directs the expression of a polypeptide.

The control sequence may be an appropriate promoter sequence. The "promoter sequence" is a relatively short nucleic acid sequence that is recognized by a host cell for expression of the longer coding region that follows. The promoter sequence contains transcriptional control sequences, which mediate the expression of the polypeptide. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

For bacterial host cells, suitable promoters for directing the transcription of the nucleic acid constructs of the present invention, include the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, Proceedings of the National Academy of Sciences USA 75: 3727-3731), as well as the tac promoter (DeBoer et al., 1983, Proceedings of the National Academy of Sciences USA 80: 21-25). Further promoters are described in "Useful proteins from recombinant bacteria" in Scientific American, 1980, 242: 74-94; and in Sambrook et al., 1989, supra.

For filamentous fungal host cells, suitable promoters for directing the transcription of the nucleic acid constructs of the present invention include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof.

In a yeast host, useful promoters are obtained from the genes for *Saccharomyces cerevisiae* enolase (ENO-1), *Saccharomyces cerevisiae* galactokinase (GAL1), *Saccharomy*-

*ces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, Yeast 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present invention.

Preferred terminators for filamentous fungal host cells are obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Preferred terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used in the present invention. Preferred leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Preferred polyadenylation sequences for filamentous fungal host cells are obtained from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, Molecular Cellular Biology 15: 5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, Microbiological Reviews 57: 109-137.

Effective signal peptide coding regions for filamentous fungal host cells are the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells are obtained from the genes for *Saccharomyces cerevisiae* alpha-factor and *Saccharomyces cerevisiae* invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the KRED polypeptide of the present invention would be operably linked with the regulatory sequence.

Thus, in another aspect, the present invention is also directed to a recombinant expression vector comprising a polynucleotide of the present invention (which encodes a KRED polypeptide of the present invention), and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present invention may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector which, exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present invention preferably contains one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3.

Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are the amdS and pyrG genes of *Aspergillus nidulans* or *Aspergillus oryzae* and the bar gene of *Streptomyces hygroscopicus*.

The expression vectors of the present invention preferably contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the expression vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori (as shown in the plasmid of FIG. 3) or the origins of replication of plasmids pBR322, pUC19, pACYC177 (which plasmid has the P15A ori), or pACYC184 permitting replication in *E. coli*, and pUB110, pE194, pTA1060, or pAM.beta.1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (see, e.g., Ehrlich, 1978, Proceedings of the National Academy of Sciences USA 75: 1433).

More than one copy of a nucleic acid sequence of the present invention may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

The procedures used to ligate the elements described above to construct the recombinant nucleic acid construct and expression vectors of the present invention are well known to one skilled in the art (see, e.g., J. Sambrook, E. F. Fritsch, and T. Maniatis, 1989, Molecular Cloning, A Laboratory Manual, 2d edition, Cold Spring Harbor, N.Y.).

Many of the expression vectors for use in the present invention are commercially available. Suitable commercial expression vectors include p3xFLAGTM™ expression vectors from Sigma-Aldrich Chemicals, St. Louis Mo., which includes a CMV promoter and hGH polyadenylation site for expression in mammalian host cells and a pBR322 origin of replication and ampicillin resistance markers for amplification in *E. coli*. Other suitable expression vectors are pBluescriptII SK(-) and pBK-CMV, which are commercially available from Stratagene, LaJolla Calif., and plasmids which are derived from pBR322 (Gibco BRL), pUC (Gibco BRL), pREP4, pCEP4 (Invitrogen) or pPoly (Lathe et al., 1987, Gene 57, 193-201).

Host Cells

In another aspect, the present invention is directed to a host cell comprising a polynucleotide encoding a KRED polypeptide of the present invention, the polynucleotide being operatively linked to one or more control sequences for expression of the KRED polypeptide in the host cell. Host cells for use in expressing the KRED polypeptides encoded by the expression vectors of the present invention are well known in the art and include but are not limited to, bacterial cells, such as *E. coli, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, 293, and Bowes melanoma cells; and plant cells. Appropriate culture mediums and conditions for the above-described host cells are well known in the art.

By way of example, *Escherichia coli* W3110 was transformed by an expression vector for expressing the variant polynucleotides of the present invention. The expression vector was created by operatively linking a variant KRED polynucleotide of the present invention into the plasmid pCK110900 operatively attached to the lac promoter under control of the lacI repressor gene. The expression vector also contained the P15A origin of replication and the chloramphenicol resistance gene. The transformed *Escherichia coli* W3110 was cultured under appropriate culture medium containing chloramphenicol such that only transformed *E coli* cells that expressed the expression vector survived. See e.g., Example 1.

Purification

Once the KRED polypeptides of the present invention were expressed by the variant polynucleotides, the polypeptides were purified from the cells and or the culture medium using any one or more of the well known techniques for protein purification, including lysozyme treatment, sonication, filtration, salting, ultra-centrifugation, affinity chromatography, and the like. Suitable solutions for lysing and the high efficiency extraction of proteins from bacteria, such as *E. coli*, are commercially available under the trade name CelLytic B™ from Sigma-Aldrich of St. Louis Mo. A suitable process for purifying the KRED polypeptides sufficiently from cell lysate for applications in a chemical process is disclosed in Example 3 herein.

Screening

Screening clones of the KRED polypeptides from the expression libraries for enhanced KRED activity is typically performed using the standard biochemistry technique of monitoring the rate of decrease (via a decrease in absorbance or fluorescence) of NADH or NADPH, as it is converted into $NAD^+$ or $NADP^+$. In this reaction, the NADH or NADPH is used up (oxidized) by the ketoreductase as the ketoreductase stereospecifically reduces a ketone substrate to the corresponding hydroxyl group. The rate of decrease of NADH or NADPH, as measured by the decrease in absorbance or fluorescence, per unit time indicates the relative (enzymatic) activity of the KRED polypeptide in a fixed amount of the lysate (or a lyophilized powder made therefrom). Such a procedure is described in Example 4 herein.

The libraries that were generated after the first round of mutations were screened and the best KRED polypeptide (SEQ ID NO: 76) had the mutations H67Q and F158Y relative to the *C. magnoliae* KRED backbone of SEQ ID NO: 2. The polynucleotide sequence (SEQ ID NO: 75) that encoded for SEQ ID NO: 76 was then resynthesized from oligomers to be codon optimized for expression in. *E. coli*. The resulting codon optimized polynucleotide had the sequence of SEQ ID NO: 77.

Thereafter, a second mutagenic or evolutionary technique was applied to the codon optimized polynucleotide of SEQ ID NO: 77 to create a second library which in turn was screened for KRED activity by the same technique. Screening the resulting clones resulted in the isolation of three clones that demonstrated between 1.5 and 4.3 times the KRED activity of the wild-type polypeptide of SEQ ID NO: 2 using either NADPH or NADH as cofactor. These clones are listed in Table 2 below along with their mutations and activity relative to the parental *C. magnoliae* based KRED backbone of SEQ ID NO: 2:

TABLE 2

| KRED Peptide No. | Mutations | Cofactor used in screening | X-fold Increase in Initial KRED Activity over KRED of SEQ ID NO: 2 | Enantio-selectivity |
|---|---|---|---|---|
| SEQ ID NO: 124 | H67Q V140I F158Y K167I V172I M177V V184I | NADH | ** | 98% |
| SEQ ID NO: 204 | H67Q, V140I, F158L, M177T, V184I | NADPH | ** | 99.9% |
| SEQ ID NO: 224 | S42N | NADPH | ** | 99.9% |

** = greater than a 150% (1.5 -fold) increase relative to SEQ ID NO: 2

The KRED polynucleotides of the present invention may be mutated or evolved to generate libraries that can be screened to identify those modified KRED polypeptides having the ability to preferentially accept other compounds as cofactors, or NADH in preference to NADPH. In particular, it was discovered that the E226G mutation caused a change in cofactor preference from NADPH to NADH (SEQ ID NOs: 102, 104, 114, 120, 122, 130, 134, 136, 140, 142, 146, 166, 178, 188, 192, 194, 208, and 210) as did E226D (SEQ ID NOs: 128 and 138) and E226K (SEQ ID NO: 216).

The KRED polynucleotides of the present invention may be mutated or evolved to generate libraries that can be screened to identify those modified KRED polypeptides having enhanced thermostability. In particular, it was discovered that the substitutions: P14A, V140I, V184I, A194V (SEQ ID NOs: 92, 276, 334, 344, 506, 526 and 542) provided for enhanced thermostability relative the polypeptide of SEQ ID NO: 2.

Thereafter, a third round library was prepared and screened for KRED activity as described herein. Four of the clones from the third round library had double the activity of the best candidates of the second round library and are listed in Table 3. A polynucleotide having SEQ ID NO: 253 was the most promising candidate. It expressed a KRED polypeptide that had the two mutations S42N and A194V relative to the KRED backbone of SEQ ID NO: 2, and that provided a 3 fold increase in initial KRED activity relative to the wild-type KRED of SEQ ID NO: 2 using NADPH as cofactor.

TABLE 3

| KRED Peptide No. | Mutations | X-fold Increase in Initial KRED Activity over KRED of SEQ ID NO: 2 | Enantio-selectivity |
|---|---|---|---|
| SEQ ID NO: 250 | S42N E160G A194V | *** | 99.9% |
| SEQ ID NO: 252 | S42N, D95Y | *** | 99.9% |
| SEQ ID NO: 254 | S165N, A194V | *** | 99.9% |
| SEQ ID NO: 256 | S42N 140I F158L M177T V184T | *** | 98.3 |
| SEQ ID NO: 260 | H67Q F158Y T235K | *** | 99.2% |

*** = greater than a 300% (3 fold) increase over SEQ ID NO: 2

The process of mutating and screening can be repeated as many times as needed, including the insertion of point mutations, to arrive at a polynucleotide that encodes a polypeptide with the desired activity, thermostability, and cofactor preference.

To obtain better expression of the polynucleotide (SEQ ID NO: 123) from the plasmid pCK110900 of FIG. 3, the polynucleotide of SEQ ID NO: 123 was reamplified using oligomers to replace nucleotides that may lead to RNA-hairpin loop formation at the SfiI site of the vector and the 5' end of the KRED mRNA. Specifically, oligos were designed to disrupt these potential stem loop structures by changing the 5'-SfiI site of the pCK110900 vector as well as replacing the AGC codon for serine at residue 6 of the encoded KRED polypeptide with the TCC codon which also coded for serine. The resulting codon optimized polynucleotide resulted in approximately three (3) fold higher expression of the KRED polypeptide, as measured by KRED activity in the lysate of the transformed and cultured host cell. Following the screening of a third round library, a polynucleotide having SEQ ID NO: 253 was the most promising candidate. However, to obtain better expression of the polynucleotide from the plasmid pCK110900 of FIG. 3, the polynucleotide of SEQ ID NO: 253 was further improved by applying evolutionary techniques and cloned in a vector in which the hairpin forming nucleotides had been removed as for SEQ ID NO: 123 above. The resulting codon optimized polynucleotides included the polynucleotides having SEQ ID NO: 303 and SEQ ID NO: 343.

In addition, the polynucleotides encoding the KRED polypeptides of the present invention may be codon optimized for optimal production from the host organism selected for expression. Those having ordinary skill in the art will recognize that tables and other references providing codon preference information for a wide range of organisms are readily available. See e.g., Henaut and Danchin, "*Escherichia coli* and *Salmonella*," Neidhardt, et al. Eds., ASM Press, Washington D.C., p. 2047-2066 (1966).

Generally, screening for transformed cells that express KRED is a two-step process. First, one physically separates the cells and then determines which cells do and do not possess a desired property. Selection is a form of screening in which identification and physical separation are achieved simultaneously by expression of a selection marker, which, in some genetic circumstances, allows cells expressing the marker to survive while other cells die (or vice versa). Exemplary screening markers include luciferase, β-galactosidase, and green fluorescent protein. Selection markers include drug and toxin resistance genes, such as resistance to chloramphenicol, ampicillin and the like. Although spontaneous selection can and does occur in the course of natural evolution, in the present methods selection is performed by man.

The KRED polynucleotides generated by the methods disclosed herein are screened in accordance with the protocol described in Example 4 to identify those having enhanced activity that are suitable for inclusion as an improved KRED polypeptide of the present invention.

The following sequence summarizes the diversity of the variant KRED polypeptides of the present invention relative to the wild-type *C. magnoliae* KRED polypeptide of SEQ ID NO: 2, as also disclosed in Genbank Acc. No. JC7338; GI:11360538, wherein one or more of the amino acid residues designated as "X" followed by the residue number are replaced to create the KRED polypeptides of the present invention:

$X_2$ $X_3$ N $X_5$ S $X_7$ V $X_9$ Y P $X_{12}$ $X_{13}$ $X_{14}$ P $X_{16}$ H $X_{18}$ $X_{19}$ $X_{20}$ $X_{21}$ $X_{22}$ $X_{23}$ $X_{24}$ $X_{25}$ L D L

F K L $X_{32}$ G K V $X_{36}$ S I T G $X_{41}$ $X_{42}$ S G $X_{45}$ G Y $X_{48}$ L A E A F A Q $X_{56}$ G A D $X_{60}$

A I W $X_{64}$ $X_{65}$ $X_{66}$ $X_{67}$ $X_{68}$ A T $X_{71}$ K A $X_{74}$ A L A $X_{78}$ $X_{79}$ Y G V K V $X_{85}$ $X_{86}$ Y K A $X_{90}$ V S $X_{93}$ S $X_{95}$ A V $X_{98}$ $X_{99}$ $X_{100}$ $X_{101}$ E $X_{103}$ Q $X_{105}$ $X_{106}$ D F G $X_{110}$ L D I $X_{114}$ V $X_{116}$ N A G $X_{120}$ P W T $X_{124}$ G A Y I $X_{129}$ Q $X_{131}$ $X_{132}$ D $X_{134}$ H F $X_{137}$ $X_{138}$ V $X_{140}$ D

V $X_{143}$ $X_{144}$ $X_{145}$ G $X_{147}$ Q Y $X_{150}$ A K $X_{153}$ A G R $X_{157}$ $X_{158}$ $X_{159}$ $X_{160}$ R $X_{162}$ $X_{163}$ $X_{164}$ $X_{165}$ G $X_{167}$ K G $X_{170}$ L $X_{172}$ $X_{173}$ T A S $X_{177}$ S

G $X_{180}$ I V N $X_{184}$ P Q F Q A $X_{190}$ Y N $X_{193}$ $X_{194}$ K A G V R H $X_{201}$ A $X_{203}$ S L A V

E $X_{209}$ A P F A R V N S $X_{218}$ S

P G Y I $X_{224}$ T $X_{226}$ I $X_{228}$ $X_{229}$ F $X_{231}$ P $X_{233}$ $X_{234}$ $X_{235}$ Q $X_{237}$ $X_{238}$ W W S L V P L

G R G G E $X_{251}$ A E L $X_{255}$ G A Y L $X_{260}$ L $X_{262}$ S D A

G S Y A T G $X_{272}$ D $X_{274}$ $X_{275}$ V D G G Y T L $X_{283}$

The diversity of changes at various residue positions for the KRED polypeptides of the present invention are shown to the right of the arrow in Table 4 below and relative amino acid residues of the wild-type *C. magnoliae* KRED polypeptide of SEQ ID NO: 2 (Genbank Acc. No. JC7338; GI:11360538) which are shown to the left of the arrow:

TABLE 4

| | |
|---|---|
| $X_2$: | A→ V |
| $X_3$: | K→ E |
| $X_5$: | F→ L, C |
| $X_7$: | N→ K |
| $X_9$: | E→ K, G |
| $X_{12}$: | A→ V |
| $X_{13}$: | P→ L |
| $X_{14}$: | P→ A |
| $X_{16}$: | A→ G, V |
| $X_{18}$: | T→ A |
| $X_{19}$: | K→ I |
| $X_{20}$: | N→ D, S |
| $X_{21}$: | E→ K |
| $X_{22}$: | S→ N, T |
| $X_{23}$: | L→ P |
| $X_{24}$: | Q→ H, R |
| $X_{25}$: | V→ A |
| $X_{32}$: | N→ D, S |
| $X_{36}$: | A→ T |
| $X_{41}$: | S→ G |
| $X_{42}$: | S→ N |
| $X_{45}$: | I→ L |
| $X_{48}$: | A→ T |
| $X_{56}$: | V→ A |
| $X_{60}$: | V→ I |
| $X_{64}$: | Y→ H |

TABLE 4-continued

| | |
|---|---|
| $X_{65}$: | N→ D, K, Y, S |
| $X_{66}$: | S→ G, R |
| $X_{67}$: | H→ L, Q |
| $X_{68}$: | D→ G, N |
| $X_{71}$: | G→ D |
| $X_{74}$: | E→ G, K |
| $X_{78}$: | K→ R |
| $X_{79}$: | K→ R |
| $X_{85}$: | K→ R |
| $X_{86}$: | A→ V |
| $X_{90}$: | N→ D |
| $X_{93}$: | S→ N, C |
| $X_{95}$: | D→ E, G, N, V, Y |
| $X_{98}$: | K→ R |
| $X_{99}$: | Q→ R, H, L |
| $X_{100}$: | T→ A |
| $X_{101}$: | I→ V |
| $X_{103}$: | Q→ R |
| $X_{105}$: | I→ V, T |
| $X_{106}$: | K→ R, Q |
| $X_{110}$: | H→ Y, C, R |
| $X_{114}$: | V→ A |
| $X_{116}$: | A→ G |
| $X_{120}$: | I→ V |
| $X_{124}$: | K→ R |
| $X_{129}$: | D→ G, N |
| $X_{131}$: | D→ G, V |
| $X_{132}$: | D→ N |
| $X_{134}$: | K→ M, V, E, R |
| $X_{137}$: | D→ G, N |
| $X_{138}$: | Q→ L |
| $X_{140}$: | V→ I |
| $X_{143}$: | D→ N |
| $X_{144}$: | L→ F |
| $X_{145}$: | K→ R |
| $X_{147}$: | V→ A |
| $X_{150}$: | V→ A |
| $X_{153}$: | H→ Y, Q |
| $X_{157}$: | H→ Y |
| $X_{158}$: | F→ L, Y |
| $X_{159}$: | R→ K |
| $X_{160}$: | E→ G, V |
| $X_{162}$: | F→ Y, S |
| $X_{163}$: | E→ G, K |
| $X_{164}$: | K→ R |
| $X_{165}$: | E→ D, G, K |
| $X_{167}$: | K→ I, R |
| $X_{170}$: | A→ S |
| $X_{172}$: | V→ I |
| $X_{173}$: | F→ C |
| $X_{177}$: | M→ V, T |
| $X_{180}$: | H→ Y |
| $X_{184}$: | V→ I |
| $X_{190}$: | T→ A |
| $X_{193}$: | A→ V |
| $X_{194}$: | A→ V |
| $X_{201}$: | F→ L |
| $X_{203}$: | K→ R |
| $X_{209}$: | F→ Y |
| $X_{218}$: | V→ I |
| $X_{224}$: | N→ S |
| $X_{226}$: | E→ K, G, D |
| $X_{228}$: | S→ T |
| $X_{229}$: | D→ A |
| $X_{231}$: | V→ I, A |
| $X_{233}$: | Q→ K, R |
| $X_{234}$: | E→ G, D |
| $X_{235}$: | T→ A, K |
| $X_{237}$: | N→ Y |
| $X_{238}$: | K→ R, E |
| $X_{251}$: | T→ A |
| $X_{255}$: | V→ A |
| $X_{260}$: | F→ L |
| $X_{262}$: | A→ V |
| $X_{272}$: | T→ A |
| $X_{274}$: | I→ L |
| $X_{275}$: | I→ L, V |
| $X_{283}$: | P→ R |

EXAMPLE 1

Construction of Expression Constructs for Expression of Ketoreductase

An analog of the gene for *Candida magnoliae* ketoreductase was codon optimized for expression in *E. coli* and synthesized based upon the known sequence disclosed as GenBank Accession No. JC7338. The analog gene was synthesized using 60-mer oligomers, and cloned into an expression vector (pCK110900 of FIG. 3) under the control of a lac promoter and lacI repressor gene, creating plasmid pKRED. The expression vector also contained the P15a origin of replication and the chloramphenicol resistance gene. Several clones were found that expressed an active ketoreductase (as per the method of Example 4) and the synthetic genes were sequenced. A sequence designated CR2-5 (SEQ ID NO: 1) was used as the starting material for all further mutations and shuffling. CR2-5 had approximately 60% nucleotide identity with the wild-type *Candida magnoliae* ketoreductase (GenBank Accession No. JC7338).

EXAMPLE 2

Production of KRED

In an aerated agitated fermentor, 10.0 L of growth medium containing 0.528 g/L ammonium sulphate, 7.5 g/L of di-potassium hydrogen phosphate trihydrate, 3.7 g/L of potassium dihydrogen phosphate, 2 g/L of Tastone-154 yeast extract, 0.05 g/L ferrous sulphate, and 3 ml/L of a trace element solution containing 2 g/L of calcium chloride dihydrate, 2.2 g/L of zinc sulfate septahydrate, 0.5 g/L manganese sulfate monohydrate, 1 g/L cuprous sulfate heptahydrate, 0.1 g/L sodium borate decahydrate and 0.5 g/L EDTA, was brought to a temperature of 30° C.

The fermentor was inoculated with a late exponential culture of *Escherichia coli* W3110 (pCR2-5) grown in a shake flask containing LB, 1% glucose (Sigma Chemical Co., St. Louis, Mo.), and 30 µg/ml chloroamphenicol (Sigma Chemical Co., St. Louis, Mo.) to a starting optical density at 600 nm ($OD_{600}$) of 0.5 to 2.0. The fermentor was agitated at 500-1500 rpm and air was supplied to the fermentation vessel at 1.0-15.0 L/min, and the pH of the culture was controlled at 7.0 by addition of 20% v/v ammonium hydroxide. After the culture reached an $OD_{600}$ of 40, the temperature was reduced to 25° C. and the expression of glucose dehydrogenase was induced by the addition of isopropyl-β-D-thiogalactoside (IPTG) (Sigma Chemical Corp., St. Louis, Mo.) to a final concentration of 1 mM. The culture was grown for another 15 hours. After the induction, the cells were harvested by centrifugation and washed with 10 mM potassium phosphate buffer, pH 7.0. The cell paste was used directly in the downstream recovery process or was stored at −80° C. until use.

EXAMPLE 3

Ketoreductase Enzyme Preparation (Lyophilized)

The cell paste was washed by suspending 1 volume wet weight of cell paste in 3 volumes of 100 mM Tris/sulfate (pH 7.2) followed by centrifugation at 5000 g for 40 minutes in a Sorval 12BP. The washed cell paste was suspended in 2 volumes of 100 mM Tris/sulfate (pH 7.2). The intracellular KRED was released from the cells by passing the suspension through a homogenizer in two passes using a pressure of 14,000 psig for the first pass and 8,000 psig for the second pass. The lysate is warmed to room temperature then a 10% w/v solution of polyethyleneimine (PEI), pH 7.2, was added to the lysate to a final PEI concentration of 0.75% w/v and stirred for 30 minutes. The treated homogenate was centrifuged at 10,000 rpm in a Beckman lab centrifuge for 60 minutes. The supernatant was decanted and dispensed in shallow containers, frozen at −20° C. and lyophilized.

EXAMPLE 4

Ketoreductase (KRED) Enzyme Activity Assay

Cells were grown overnight in terrific broth (TB) with 1% glucose and 30 ug/ml chloramphenicol. This culture was diluted 10-fold into fresh TB containing 30 ug/ml chloramphenicol and after 2 hours of growth at 30° C., ⅛ volume TB with 30 ug/ml chloramphenicol and 8 mM IPTG (isopropyl thiogalactoside) was added. The culture (0.5 ml) was allowed to grow another 6 hours at 30° C.

Lysis buffer contains 100 mM triethanolamine buffer (pH 7.0), 2 mg/ml PMBS (polymixin B sulfate), 2 ul of Dnase (2000 U/ml), 1 mg/ml lysozyme, 1 mM PMSF (phenyl methyl sulfonyl fluoride).

Cells are pelleted via centrifugation and lysed in 0.25 ml lysis buffer by shaking at room temperature for 2 hours.

Assay mix is the aqueous phase obtained by mixing 1 volume of 100 mM triethanolamine buffer (pH 7.0), 0.1 to 0.2 mM NADPH or NADH, 600 mM glucose, and 600 mM gluconic acid with one volume of a solution of 1 part ethyl-4-chloro-3-keto-butyrate (ECKB) and 2 parts butyl acetate for 10 minutes and allowing the phases to separate. The reaction was initiated by adding the ketoreductase enzyme as a predissolved solution in 100 mM triethanolamine buffer (pH 7.0). The course of reaction was followed by measurement of the decrease of absorbance at 340 nm or by the fluorescent emission of light at 440 nm as a function of time. The results were plotted as Absorbance units or relative fluorescent units (RFU) (NADPH or NADH) vs. time, and the slope of the plot determined (Absorbance units/min or RFU/min).

While the invention has been described with reference to certain embodiments, it will be understood by those skilled in the art that various changes may be made and equivalents may be substituted without departing from the scope of the invention. In addition, many modifications may be made to adapt a particular situation or material to the teachings of the invention without departing from its scope. Therefore, it is intended that the invention not be limited to the particular embodiment disclosed, but that the invention will include all embodiments falling within the scope of the appended claims.

EXAMPLE 5

KRED/GDH Coupled Chemistry Assay

To a 100 mL vessel equipped with a pH electrode-controlled automatic titrator was charged a solution of glucose (7.5 g) in 100 mM triethanolamine pH 7 buffer (25 mL). To this solution were charged the two enzymes (100 mg KRED; 50 mg GDH) and NADP (6.25 mg). Butyl acetate (10 ml) was then charged. Finally, ethyl 4-chloroacetoacetate (6 g) in butyl acetate (10 mL) was charged to the vessel. 4M NaOH is added dropwise on demand by the automatic titrator (a pH of 6.85 was set as a lower limit) to constantly adjust the pH to 7.0. The reaction was complete when no more caustic was needed. The reaction rates were determined by measuring the amount of base added per unit time or by taking samples of the reaction mixture, extracting the sample 3 times with an equal volume of ethyl acetate, and analyzing the combined organic layers by gas chromatography to determine the amount of ethyl (S)-4-chloro-3-hydroxybutyrate produced per unit time.

While the invention has been described with reference to certain embodiments, it will be understood by those skilled in the art that various changes may be made and equivalents may be substituted without departing from the scope of the invention. In addition, many modifications may be made to adapt a particular situation or material to the teachings of the invention without departing from its scope. Therefore, it is intended that the invention not be limited to the particular embodiment disclosed, but that the invention will include all embodiments falling within the scope of the appended claims.

SEQUENCE LISTING (542 sequences)

SEQ ID NO: 1 - DNA, 852 bp, Artificial Sequence
  Variant based upon the ketoreductase of Candida magnoliae
  misc_feature: CR2-05orf
  CDS (1)..(852)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaa

SEQ ID NO: 2 - protein, 283 aa, Artificial Sequence
  Variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 3 - DNA, 855 bp, Artificial Sequence
  laboratory generated variant based upon the ketoreductase of Candida magnoliae (krh002)
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaggaagtatggagtaaaggtaaaggcatataaagcaaatgtaagcagcagcgatgcagtcaagcaaacaatagagcaacaaataaaggattttggacatttagatatagtagtggcaaatgcaggaataccctggacaaagggagcatatatagatcaagatgatgacaagcattttgaccaagtagtagatgtagacttaaagggagtaggatacgtagcaaagtatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 4 - protein, 283 aa, Artificial Sequence
  laboratory generated variant based upon the ketoreductase of Candida magnoliae (krh002)
MAKNFSNVEYPAPPPAHTKNESLQVLDLFKLNGKVASITGSSSGIGYALAEAFAQVGADVAIWYNSHDATGKAEALARKYGVKVKAYKANVSSSDAVKQTIEQQIKDFGHLDIVVANAGIPWTKGAYIDQDDDKHFDQVVDVDLKGVGYVAKYAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 5 - DNA, 855 bp, Artificial Sequence; identical to SEQ ID NO: 3
  laboratory generated variant based upon the ketoreductase of Candida magnoliae (krh003)
  CDS (1)..(855)

SEQ ID NO: 6 - protein, 283 aa, Artificial Sequence; identical to SEQ ID NO: 4
  laboratory generated variant based upon the ketoreductase of Candida magnoliae (krh003)

SEQ ID NO: 7 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccaagatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtaggaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 8 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVGNAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 9 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaggaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaggagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 10 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALARKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 11 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcacgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 12 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASTSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 13 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcgtgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 14 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 15 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacgagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatttaatagtagatggaggatatacattaccctaatga

SEQ ID NO: 16 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDEHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDLIVDGGYTLP

SEQ ID NO: 17 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccaagatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 18 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 19 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagggataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 20 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 21 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggtaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcatcagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 22 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSISPGYINTEISDFVPQETQNKWWSLVPLGRGGETAELVGAYLFLASDAGSYATGTDIIVDGGYTLP

SEQ ID NO: 23 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcgatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattaatatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagatatatccgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 24 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALIFTASMSGHIVNVPQFQATYNAAKAGVRHFAKSLAVEFAPFARVNSVSPGYINTDISDFVPQETQNKWWSLVPLGRGGETAELVGAYLFLASDAGSYATGTDIIVDGGYTLP

SEQ ID NO: 25 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcgggataggatatgcattagcagaggcttttgcacaagtcggagcagatgtagcaatatggtataacagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttaaagaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcatcagccccggatatataaatacagagataagcgatttcgtcccccaagagacacaaaataagtggtggagcttagtccccttaggaaggggaggagagacagcagagttggtaggagcatatttattcttagcaagcgatgcaggaagctatgcaacaggaacagatataatagtagatggaggatatacattaccctaatga

SEQ ID NO: 26 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFKERFEKEGKKGALVFTASMSGHIVNVPQFQATYNAAKAGVRHFAKSLAVEFAPFARVNSISPGYINTEISDFVPQETQNKWWSLVPLGRGGETAELVGAYLFLASDAGSYATGTDIIVDGGYTLP

SEQ ID NO: 27 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggatttcggacatttagatatagtagtagcaaatgcaggaataccctggacaaagggagcatatatagatcaagatgatgacaagcattttgaccaagtagtagatgtagacttaaagggagtaggatatgtagcaaagcatgcaggaaggcattttagggaaaggtttgagaaagagggaaaaaagggagcattagtatttacggcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtccccaaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 28 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPKETQNKWWSLVPLGRGGETAELVGAYLFLASDAGSYATGTDIIVDGGYTLP

SEQ ID NO: 29 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcctttgcacaagtcggagcagatgtagcaatatggtataatagccatgatgcaacaggaaaagcagaggcattagcaaagaagtacggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatatcccccaattccaagcaacatataatgcagcaaaggcaggagtaaggcattttgcaaagagcttagcagtcgagtttgcaccctttgcaagggtaaatagcgtaagccccggatatataaatacagagataagcgatttcatcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 30 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNIPQFQATYNAAKAGVRHFAKSLAVEFAPFARVNSVSPGYINTEISDFIPQETQNKWWSLVPLGRGGETAELVGAYLFLASDAGSYATGTDIIVDGGYTLP

SEQ ID NO: 31 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggtataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagtaagcgatgcaggaagctatgcaacaggaacagatataatagtagatggaggatatacattaccctaatga

SEQ ID NO: 32 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLVSDAGSYATGTDIIVDGGYTLP

SEQ ID NO: 33 - DNA, 855 bp, Artificial Sequence
  laboratory generated variant based upon the ketoreductase of Candida magnoliae
  CDS (1)..(855)
atggtaaagaattttagcaatgtagagtatcccgcacccccccccgcacatacaaagaatgagaccttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacgggaacagatataatagtagatggaggatatacattaccctaatga

SEQ ID NO: 34 - protein, 283 aa, Artificial Sequence
  laboratory generated variant based upon the ketoreductase of Candida magnoliae
MVKNFSNVEYPAPPPAHTKNETLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 35 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcaacagcgatgcagtcaagcaaacaatagagcaacaaataaaggattttggatatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 36 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSNSDAVKQTIEQQIKDFGYLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 37 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatatagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattaatttttacagcaagcatgagcggacatatagtaaatgttccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagatacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 38 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADIAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALIFTASMSGHIVNVPQFQATYNAAKAGVRHFAKSLAVEFAPFARVNSVSPGYINTEISDFVPQDTQNKWWSLVPLGRGGETAELVGAYLFLASDAGSYATGTDIIVDGGYTLP

SEQ ID NO: 39 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcaatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 40 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSNAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 41 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtgttagatttatttaagttaaatggaaaagtagcaagcataacaggaggcagcagcggaataggatatgcattagcagaggcttttgcacaagtcggagcagatgtagcaatatggtataatagccttgatgcaacaggaaaagcagaggcattagcaaagaagtatggagtaaaggtaaaggcatataaagcaaatgtaagcagcagcgatgcagtcaagcaaacaatagagcaacaaataaaggattttggacgtttagatatagtagttgcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtatgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 42 - protein, 283 aa, Artificial Sequence
  laboratory generated variant based upon the ketoreductase of Candida magnoliae
MAKNFSNVEYPAPPPAHTKNESLQVLDLFKLNGKVASITGGSSGIGYALAEAFAQVGADVAIWYNSLDATGKAEALAKKYGVKVKAYKANVSSSDAVKQTIEQQIKDFGRLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEYAPFARVNSVSPGYINTEISDFVPQETQNKWWSLVPLGRGGETAELVGAYLFLASDAGSYATGTDIIVDGGYTLP

SEQ ID NO: 43 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatgtacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 44 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVCTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 45 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttcaagggagtaggatacgtagcaaagcaagcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 46 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDFKGVGYVAKQAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 47 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagaacttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 48 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 49 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgacctagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 50 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDLVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 51 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacatgcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 52 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDMHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 53 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagcagtagcaaatgcaggaataccctggacaaagggagcatatatagatcaagatgatgacaagcattttgaccaagtagtagatgtagacttaaagggagtaggatacgtagcaaagcatgcaggaaggcatttaagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 54 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIAVANAGIPWTKGAYIDQDDDKHFDQVVDVDLKGVGYVAKHAGRHLRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 55 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagctgcagcgatgcagtcaagcatacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 56 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSCSDAVKHTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 57 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggtcatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatatagtagtagatggaggatatacattaccctaatga

SEQ ID NO: 58 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 59 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacatgtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 60 - protein, 283 aa, Artificial Sequence
  laboratory generated variant based upon the ketoreductase of Candida magnoliae
MAKNFSNVEYPAPPPAHTKNESLHVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 61 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaagggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaagaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 62 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVRAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 63 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccggacatacaaagaatgagagcttacaagtattagatttatttaagttaaatggaaaagtagcaagcataacaggaagcagcagcggaataggatatgcattagcagaggctttcgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 64 - protein, 283 aa, Artificial Sequence
  laboratory generated variant based upon the ketoreductase of Candida magnoliae
MAKNFSNVEYPAPPPGHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 65 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatacattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaaaggagtaggatacgtagcaaagcatgcaggaaggcattttagggaaaggtttgagaaagagggaataaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccgagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 66 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYTLAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGIKGALVFTASMSGHIVNVPQFQATYNAAKAGVRHFAKSLAVEFAPFARVNSVSPGYINTEISDFVPRETQNKWWSLVPLGRGGETAELVGAYLFLASDAGSYATGTDIIVDGGYTLP

SEQ ID NO: 67 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggcataatagccatgatgcaacaggaaaagcagaggcattagcaaagaagtatggagtaaaggtaaaggcatataaagcaaatgtaagcagcagcgaggcagtcaagcaaacagtagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 68 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWHNSHDATGKAEALAKKYGVKVKAYKANVSSSEAVKQTVEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 69 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggtatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcactttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 70 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKVYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 71 - DNA, 855 bp, Artificial Sequence
  laboratory generated variant based upon the ketoreductase of Candida magnoliae
  CDS (1)..(855)
atggcaaagaatttcagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataaaagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggtgagacagcagagttagtaggagcatatttattcttagcaagcgatgcaggaagctatgcaacaggaacagatataatagtagatggaggatatacattaccctaatga

SEQ ID NO: 72 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYKSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 73 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagttacaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataacgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 74 - protein, 283 aa, Artificial Sequence
  laboratory generated variant based upon the ketoreductase of Candida magnoliae
MAKNFSNVEYPAPPPAHTKNESLQVLDLFKLNGKVTSITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 75 - DNA, 852 bp, Artificial Sequence
  laboratory generated variant based upon the ketoreductase of Candida magnoliae
  CDS (1)..(852)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccaagatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattatagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaactgatataatagtagatggaggatatacattaccctaa

SEQ ID NO: 76 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 77 - DNA, 852 bp, Artificial Sequence
  laboratory generated variant based upon the ketoreductase of Candida magnoliae
  CDS (1)..(852)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 78 - protein, 283 aa, Artificial Sequence; identical to SEQ ID NO: 76
  laboratory generated variant based upon the ketoreductase of Candida magnoliae

SEQ ID NO: 79 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaatacaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 80 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIQDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 81 - DNA, 855 bp, Artificial Sequence
  laboratory generated variant based upon the ketoreductase of Candida magnoliae
  CDS (1)..(855)
atggcagagaattgtagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 82 - protein, 283 aa, Artificial Sequence
  laboratory generated variant based upon the ketoreductase of Candida magnoliae
MAENCSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 83 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtaatagatgtagacttaaggggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 84 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVIDVDLRGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 85 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatatcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 86 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 87 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaagcaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgctaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 88 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQAIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 89 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaagggcatataaagcaaatgtaagcagcagcgatgcagtcaagcaagcaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaagaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 90 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVRAYKANVSSSDAVKQAIEQQIKDFGHLDIVVANAGIPWTKGAYIDQDDDKHFDQVVDVDLKGVGYVAKHAGRHFRERFEKEGRKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 91 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtaatagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagacggaggatatacattaccctaatga

SEQ ID NO: 92 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVIDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 93 - DNA, 855 bp, Artificial Sequence
  laboratory generated variant based upon the ketoreductase of Candida magnoliae
  CDS (1)..(855)
atggcagagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcagatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtaaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 94 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSHDATGKAEALAKKYGVKVKAYKADVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 95 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcaacagcggaataggatatgcattagcagaggcttttgcacaagtcggagcagatgtagcaatatggtataatagccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggagcattagtatttacagcaagcatgagcggacatatagtgaatgtcccccaattccaagcaacatataatgcagcaaaggcaggagtaaggcattttgcaaagagcttagcagtcgagtttgcaccctttgcaagggtaaatagcgtaagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 96 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 97 - DNA, 855 bp, Artificial Sequence
  laboratory generated variant based upon the ketoreductase of Candida magnoliae
  CDS (1)..(855)
atggcaaagaattttagcaatgtagagtatcccgcacccccccccgcacatacaaagaatgagagcttacaagtattagatttatttaagttaaatggaaaagtagcaagcataacaggaagcagcagcggaataggatatgcattagcagaggcttttgcacaagtcggagcagatgtagcaatatggtataatggccatgatgcaacaggaaaagcagaggcattagcaaagaagtatggagtaaaggtaaaggcatataaagcaaatgtaagcagcagcgatgcagtcaagcaaacaatagagcaacaaataaaggattttggacatttagatatagtagtagcaaatgcaggaataccctggacaaagggagcatatatagatcaagatgatgacaagcattttgaccaagtagtagatgtagacttaaagggagtaggatacgtagcaaagcatgcaggaaggcattttagggaaaggtttgagaaagagggaaaaaagggatccttaatttttacagcaagcatgagcggacatatagtaaatgtcccccaattccaagcaacatataatgcagcaaaggcaggagtaaggcattttgcaaagagcttagcagtcgagtttgcaccctttgcaagggtaaatagcatcagccccggatatataaatacagagataagcgatttcgtcccccaagagacacaaaataagtggtggagcttagtccccttaggaaggggaggagagacagcagagttagtaggagcatatttattcttagcaagcgatgcaggaagctatgcaacaggaacagatataatagtagatggaggatatacattaccctaatga

SEQ ID NO: 98 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNGHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGSLIFTASMSGHIVNVPQFQATYNAAKAGVRHFAKSLAVEFAPFARVNSISPGYINTEISDFVPQETQNKWWSLVPLGRGGETAELVGAYLFLASDAGSYATGTDIIVDGGYTLP

SEQ ID NO: 99 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacaggctattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcataaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 100 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSQDATGKAEALAKKYGVKVKAYKANVSSSDAVKQAIEQQIKDFGHLDIVVANAGIPWTKGAYIDQDDDEHFDQVIDVDLKGVGYVAKHAGRHYRERFEKEGIKGALIFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 101 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 102 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 103 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcagggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 104 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALARKYGVKVRAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 105 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcaaggcttataaagctaatgtcagctgtagtaatgcggtgaaacaggctattgagcagcagatcaaggattttggccacctggacattgttgtggcgaacgcaggcatcccatggactaagggtgcatacatcgatcaggatgacgataagcattttgaccaggtgattgacgtcgacctgaaaggcgtaggctatgtagcaaaatacgcgggtcgccatcttcgtgaacgtttcgaaaaagaaggcaaaaagggcgccttgatttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 106 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSQDATGKAEALARKYGVKVKAYKANVSCSNAVKQAIEQQIKDFGHLDIVVANAGIPWTKGAYIDQDDDKHFDQVIDVDLKGVGYVAKYAGRHLRERFEKEGKKGALIFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 107 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggctacctggacattgttgtggcgaacgcaggcatcccatggactaagggtgcatacatcgatcaggatgacgataagcattttgaccaggtgattgacgtcgacctgaaaggcgtaggctatgtagcaaaacatgcgggtcgccatcttcgtgaacgtttcgaaaaagaaggcaaaaagggcgccttggtttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 108 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGYLDIVVANAGIPWTKGAYIDQDDDKHFDQVIDVDLKGVGYVAKHAGRHLRERFEKEGKKGALVFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 109 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatttgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 110 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDEHFDQVIDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 111 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccattatcgtgaacgtttcgaaaaagaaggcagaaagggcgccttgatttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 112 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHYRERFEKEGRKGALIFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 113 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatatgcattttgaccaggtgattgacgtcgacctgaaaggcgtaggctatgtagcaaaatacgcgggtcgccatcttcgtgaacgtttcgaaaaagaaggcaaaaagggcgccttggtttttacggcttccacgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 114 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDMHFDQVIDVDLKGVGYVAKYAGRHLRERFEKEGKKGALVFTASTSGHIVNIPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 115 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaatacgcgggtcgccatcttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 116 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDEHFDQVIDVDLKGVGYVAKYAGRHLRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 117 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggctgcctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccatcttcgtgaacgtttcgaaaaagaaggcagaaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 118 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSQDATGKAEALAKKYGVKVKAYKANVSSSDAVKQTIEQQIKDFGCLDIVVANAGIPWTKGAYIDQDDDVHFDQVIDVDLKGVGYVAKHAGRHLRERFEKEGRKGALIFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 119 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 120 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDEHFDQVIDVDLKGVGYVAKHAGRHYRERFEKEGKKGALVFTASMSGHIVNIPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 121 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaactctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccattatcgtgaacgtttcgaaaaagaaggcagaaagggcgccttgatttttacggcttccacgtcgggtcacatcgttaacattccgcaatttcaggcgacctacaatgtggccaaggcaggcgtgcgtcatttcgcaaagtccctggccgtggaatttgctcctttcgcacgtgttaactccgtatctcctggctatattaataccggcatctctgatttcgtcccgagagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 122 - protein, 283 aa, Artificial Sequence
  laboratory generated variant based upon the ketoreductase of Candida magnoliae
MAKNFSNVEYPAPPPAHTKNETLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHYRERFEKEGRKGALIFTASTSGHIVNIPQFQATYNVAKAGVRHFAKSLAVEFAPFARVNSVSPGYINTGISDFVPRETQNKWWSLVPLGRGGETAELVGAYLFLASDAGSYATGTDIIVDGGYTLP

SEQ ID NO: 123 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccattatcgtgaacgtttcgaaaaagaaggcataaagggcgccttgatttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 124 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVIDVDLKGVGYVAKHAGRHYRERFEKEGIKGALIFTASVSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 125 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccatcttcgtgaacgtttcgaaaaagaaggcaaaaagggcgccttggtttttacggcttccatgtcgggtcacatcgttaacgtgccgcaattccaggcgacctacaatgtggccaaggcaggcgtgcgtcatttcgcaaagtccctggccgtggaatttgctcctttcgcacgtgttaactctgtatctcctggctatattaataccgacatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 126 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALARKYGVKVKAYKANVSSSDAVKQTIEQQIKDFGHLDIVVANAGIPWTKGAYIDQDDDVHFDQVIDVDLKGVGYVAKHAGRHLRERFEKEGKKGALVFTASMSGHIVNVPQFQATYNVAKAGVRHFAKSLAVEFAPFARVNSVSPGYINTDISDFVPKETQNKWWSLVPLGRGGETAELVGAYLFLASDAGSYATGTDIIVDGGYTLP

SEQ ID NO: 127 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatatgcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 128 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDMHFDQVIDVDLKGVGYVAKHAGRHYRERFEKEGKKGALVFTASMSGHIVNVPQFQATYNAAKAGVRHFAKSLAVEFAPFARVNSVSPGYINTEISDFVPKETQNKWWSLVPLGRGGETAELVGAYLFLASDAGSYATGTDIIVDGGYTLP

SEQ ID NO: 129 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcagggcttataaagctaatgtcagctcgagtgatgcggtgaaacagactattgagcagcagatcaaggattttggccacctggacattgttgtggcgaacgctggcatcccatggactaagggtgcatacatcgatcaggatgacgatgtgcattttgaccaggtgattgacgtcgacctgaaaggcgtaggctatgtagcaaaatacgcgggtcgccatcttcgtgaacgtttcgaaaaagaaggcataaagggcgccttgatttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 130 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSQDATGKAEALARKYGVKVRAYKANVSSSDAVKQTIEQQIKDFGHLDIVVANAGIPWTKGAYIDQDDDVHFDQVIDVDLKGVGYVAKYAGRHLRERFEKEGIKGALIFTASMSGHIVNIPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 131 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaactctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgacatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 132 - protein, 283 aa, Artificial Sequence
  laboratory generated variant based upon the ketoreductase of Candida magnoliae
MAKNFSNVEYPAPPPAHTKNETLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHYRERFEKEGKKGALVFTASMSGHIVNVPQFQATYNAAKAGVRHFAKSLAVEFAPFARVNSVSPGYINTDISDFVPKETQNKWWSLVPLGRGGETAELVGAYLFLASDAGSYATGTDIIVDGGYTLP

SEQ ID NO: 133 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaaactctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaatacgcgggtcgccatcttcgtgaacgtttcgaaaaagaaggcaaaaagggcgccttggtttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 134 - protein, 283 aa, Artificial Sequence
  laboratory generated variant based upon the ketoreductase of Candida magnoliae
MAENFSNVEYPAPPPAHTKNETLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKYAGRHLRERFEKEGKKGALVFTASVSGHIVNIPQFQATYNAAKAGVRHFAKSLAVEFAPFARVNSVSPGYINTGISDFVPKETQNKWWSLVPLGRGGETAELVGAYLFLASDAGSYATGTDIIVDGGYTLP

SEQ ID NO: 135 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 136 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTGISDFVPKETQNKWWSLVPLGRGGETAELVGAYLFLASDAGSYATGTDIIVDGGYTLP

SEQ ID NO: 137 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctgtagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcagaaagggcgccttgatttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgacatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 138 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSQDATGKAEALAKKYGVKVKAYKANVSCSDAVKQTIEQQIKDFGHLDIVVANAGIPWTKGAYIDQDDDKHFDQVVDVDLKGVGYVAKHAGRHLRERFEKEGRKGALIFTASMSGHIVNIPQFQATYNAAKAGVRHFAKSLAVEFAPFARVNSVSPGYINTDISDFVPQETQNKWWSLVPLGRGGETAELVGAYLFLASDAGSYATGTDIIVDGGYTLP

SEQ ID NO: 139 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcataaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 140 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGIKGALIFTASMSGHIVNVPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 141 - DNA, 852 bp, Artificial Sequence
  laboratory generated variant based upon the ketoreductase of Candida magnoliae
  CDS (1)..(852)
atggctgaaaactttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcagggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccatcttcgtgaacgtttcgaaaaagaaggcataaagggcgccttggtttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgagagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 142 - protein, 283 aa, Artificial Sequence
  laboratory generated variant based upon the ketoreductase of Candida magnoliae
MAENFSNVEYPAPPPAHTKNENLQVLDLFKLNGKVASITGSSSGIGYALAEAFAQVGADVAIWYNSQDATGKAEALARKYGVKVRAYKANVSSSDAVKQTIEQQIKDFGHLDIVVANAGIPWTKGAYIDQDDDKHFDQVIDVDLKGVGYVAKHAGRHLRERFEKEGIKGALVFTASVSGHIVNIPQFQATYNAAKAGVRHFAKSLAVEFAPFARVNSVSPGYINTGISDFVPRETQNKWWSLVPLGRGGETAELVGAYLFLASDAGSYATGTDIIVDGGYTLP

SEQ ID NO: 143 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtggtggacgtcgacctgaaaggcgtaggctatgtagcaaaacatgcgggtcgccatcttcgtgaacgtttcgaaaaagaaggcagaaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 144 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVVDVDLKGVGYVAKHAGRHLRERFEKEGRKGALIFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 145 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcataaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 146 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGIKGALVFTASMSGHIVNVPQFQATYNAAKAGVRHFAKSLAVEFAPFARVNSVSPGYINTGISDFVPKETQNKWWSLVPLGRGGETAELVGAYLFLASDAGSYATGTDIIVDGGYTLP

SEQ ID NO: 147 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccatcttcgtgaacgtttcgaaaaagaaggcataaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 148 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVIDVDLKGVGYVAKHAGRHLRERFEKEGIKGALIFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 149 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacaggctattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcataaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 150 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSQDATGKAEALAKKYGVKVKAYKANVSSSDAVKQAIEQQIKDFGHLDIVVANAGIPWTKGAYIDQDDDEHFDQVIDVDLKGVGYVAKHAGRHYRERFEKEGIKGALIFTASMSGHIVNVPQFQATYNAAKAGVRHFAKSLAVEFAPFARVNSVSPGYINTEISDFVPKETQNKWWSLVPLGRGGETAELVGAYLFLASDAGSYATGTDIIVDGGYTLP

SEQ ID NO: 151 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctccagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaagaagggcgcattggtctgtacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtctctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 152 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKADVSSSDAVKQTIEQQIKDFGHLDIVVANAGIPWTKGAYIDQDDDKHFDQVVDVDLKGVGYVAKHAGRHYRERFEKEGKKGALVCTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 153 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 154 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 155 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcatctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctgcagtgacgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 156 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKADVSCSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 157 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatctaagggaacgtttcgaaaaagaaggcaagaagggctcattgatctttacggcttccatgtcgggtcacatcgttaacatcccgcaatttcaggcgacctacaatgcggccaaggcaggcgtgcgtcatttcgcaaagtccctggccgtggaatttgctcctttcgcacgtgttaactctgtatctcctggctatattaataccgagatcactgatttcgtcccgcaagaaacacaaaataaatggtggagcttagttccattgggtcgtggtggggaaactgcggaattagttggtgcctacctgttcctggcaagtgatgcgggctcctacgccacgggcacagatattgtcgtggatggcggctacacgctgccgtaatga

SEQ ID NO: 158 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGSLIFTASMSGHIVNIPQFQATYNAAKAGVRHFAKSLAVEFAPFARVNSVSPGYINTEITDFVPQETQNKWWSLVPLGRGGETAELVGAYLFLASDAGSYATGTDIVVDGGYTLP

SEQ ID NO: 159 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctgcagtgaagcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatctaaaggaacgtttcgaaaaagaaggcaaaaagggcgccttggtttttacggcttccacatcgggtcacatcgttaacgtgccgcaatttcaggcgacctacaatgcggccaaggcaggcgtgcgtcatttcgcaaagtccctggccgtggaatttgctcctttcgcacgtgttaactctgtctctcctggctatattaataccgagatctctgatttcgtcccgcaagaaacacaaaataaatggtggagcttagttccattgggtcgtggtggggaaactgcggaattagttggtgcctacctgttcctggtgagtgatgcgggctcctacgccacgggcacagatattatcgtggatggcggctacacgctgccgtaatga

SEQ ID NO: 160 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKADVSCSEAVKQTIEQQIKDFGHLDIVVANAGIPWTKGAYIDQDDDKHFDQVVDVDLKGVGYVAKHAGRHLKERFEKEGKKGALVFTASTSGHIVNVPQFQATYNAAKAGVRHFAKSLAVEFAPFARVNSVSPGYINTEISDFVPQETQNKWWSLVPLGRGGETAELVGAYLFLVSDAGSYATGTDIIVDGGYTLP

SEQ ID NO: 161 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtattacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 162 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYYSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 163 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctccagtgatgcggtgaaacagactattgagcagcagatcaaggattttggccacctggacattgttgtggcgaacgcaggcatcccatggactaagggtgcatacatcgatcaggatgacgatgagcattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggtgagtgatgcgggctcctacgccacgggcacagatatcattgtggatggcggctacacgctgccgtaatga

SEQ ID NO: 164 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKADVSSSDAVKQTIEQQIKDFGHLDIVVANAGIPWTKGAYIDQDDDEHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLVSDAGSYATGTDIIVDGGYTLP

SEQ ID NO: 165 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcagaaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgagagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 166 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGRKGALIFTASMSGHIVNVPQFQATYNAAKAGVRHFAKSLAVEFAPFARVNSVSPGYINTGISDFVPRETQNKWWSLVPLGRGGETAELVGAYLFLASDAGSYATGTDIIVDGGYTLP

SEQ ID NO: 167 - DNA, 855 bp, Artificial Sequence
  laboratory generated variant based upon the ketoreductase of Candida magnoliae
  CDS (1)..(855)
atggctaaaaactttagcaatgtcgaatatcctgtcccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcagggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccatcttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 168 - protein, 283 aa, Artificial Sequence
  laboratory generated variant based upon the ketoreductase of Candida magnoliae
MAKNFSNVEYPVPPPAHTKNESLQVLDLFKLNGKVASITGSSSGIGYALAEAFAQVGADVAIWYNSQDATGKAEALARKYGVKVRAYKANVSSSDAVKQTIEQQIKDFGHLDIVVANAGIPWTKGAYIDQDDDEHFDQVIDVDLKGVGYVAKHAGRHLRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 169 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaactctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcagggcttataaagctaatgtcagctcgagtgatgcggtgaaacaggctattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacacgcgggtcgccatcttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 170 - protein, 283 aa, Artificial Sequence
  laboratory generated variant based upon the ketoreductase of Candida magnoliae
MAKNFSNVEYPAPPPAHTKNETLQVLDLFKLNGKVASITGSSSGIGYALAEAFAQVGADVAIWYNSQDATGKAEALAKKYGVKVRAYKANVSSSDAVKQAIEQQIKDFGHLDIVVANAGIPWTKGAYIDQDDDEHFDQVIDVDLKGVGYVAKHAGRHLRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 171 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcagaaagggcgccttgatttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 172 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDEHFDQVIDVDLKGVGYVAKHAGRHYRERFEKEGRKGALIFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 173 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaagacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaatacgcgggtcgccatcttcgtgaacgtttcgaaaaagaaggcaaaaagggcgccttggtttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctatatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 174 - protein, 283 aa, Artificial Sequence
  laboratory generated variant based upon the ketoreductase of Candida magnoliae
MAKNFSNVEYPAPPPAHTKDESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKYAGRHLRERFEKEGKKGALVFTASMSGHIVNIPQFQATYNAAKAGVRHFAKSLAVEFAPFARVNSISPGYINTEISDFVPQETQNKWWSLVPLGRGGETAELVGAYLFLASDAGSYATGTDIIVDGGYTLP

SEQ ID NO: 175 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggactttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 176 - protein, 283 aa, Artificial Sequence; identical to SEQ ID NO: 110
  laboratory generated variant based upon the ketoreductase of Candida magnoliae

SEQ ID NO: 177 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaagctgcggaattagttggtgcctacctgttcctggcaagtgatgcgggctcctacgccacgggcacagatatcattgtggatggcggctacacgctgccgtaatga

SEQ ID NO: 178 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALIFTASMSGHIVNVPQFQATYNAAKAGVRHFAKSLAVEFAPFARVNSVSPGYINTGISDFVPQETQNKWWSLVPLGRGGEAAELVGAYLFLASDAGSYATGTDIIVDGGYTLP

SEQ ID NO: 179 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagccaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcaaaaagggcgccttgatttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 180 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGALIFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 181 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacattccgcaatttcaggcgacctacaatgcggccaaggcaggcgtgcgtcattttgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacactgccgtaatga

SEQ ID NO: 182 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHYRERFEKEGKKGALVFTASMSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 183 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcagggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccatcttcgtgaacgtttcgaaaaagaaggcagaaagggcgccttgatttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 184 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALARKYGVKVRAYKANVSSSDAVKQTIEQQIKDFGHLDIVVANAGIPWTKGAYIDQDDDEHFDQVIDVDLKGVGYVAKHAGRHLRERFEKEGRKGALIFTASVSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 185 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 186 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDEHFDQVIDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 187 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgagagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 188 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTGISDFVPRETQNKWWSLVPLGRGGETAELVGAYLFLASDAGSYATGTDIIVDGGYTLP

SEQ ID NO: 189 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccatcttcgtgaacgtttcgaaaaagaaggcaaaaagggcgccttggtttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgctcctggcaagtgatgcgggctcctacgccacgggcacagatatcattgtggatggcggctacacgctgccgtaatga

SEQ ID NO: 190 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHLRERFEKEGKKGALVFTASVSGHIVNVPQFQATYNAAKAGVRHFAKSLAVEFAPFARVNSVSPGYINTEISDFVPQETQNKWWSLVPLGRGGETAELVGAYLLLASDAGSYATGTDIIVDGGYTLP

SEQ ID NO: 191 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccattatcgtgaacgtttcgaaaaagaaggcagaaagggcgccttgatttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgaaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 192 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHYRERFEKEGRKGALIFTASVSGHIVNIPQFQATYNAAKAGVRHFAKSLAVEFAPFARVNSVSPGYINTGISDFVPKETQNKWWSLVPLGRGGETAELVGAYLFLASDAGSYATGTDIIVDGGYTLP

SEQ ID NO: 193 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggactttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgagagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 194 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDVHFDQVIDVDLKGVGYVAKHAGRHYRERFEKEGKKGALVFTASMSGHIVNIPQFQATYNAAKAGVRHFAKSLAVEFAPFARVNSVSPGYINTGISDFVPRETQNKWWSLVPLGRGGETAELVGAYLFLASDAGSYATGTDIIVDGGYTLP

SEQ ID NO: 195 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 196 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 197 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctgtagtgaggcggtgaaacaggctattgagcagcagatcaaggattttggctgcctggacattgttgtggcgaacgcaggcatcccatggactaagggtgcatacatcgatcaggatgacgatgtgcattttgaccaggtgattgacgtcgacctgaaaggcgtaggctatgtagcaaaacacgcgggtcgccatcttcgtgaacgtttcgaaaaagaaggcagaaagggcgccttgatttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 198 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSCSEAVKQAIEQQIKDFGCLDIVVANAGIPWTKGAYIDQDDDVHFDQVIDVDLKGVGYVAKHAGRHLRERFEKEGRKGALIFTASVSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 199 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccataaacgaaactctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctagaaaatatggcgtaaaagtcaaggcttataaagctaatgtcagctgtagtgatgcggtgaaacaggctattgagcagcagatcaaggattttggccgcctggacattgttgtggcgaacgcaggcatcccatggactaagggtgcatacatcgatcaggatgacgatgagcattttgaccaggtgattgacgtcgacctgaaaggcgtaggctatgtagcaaaacatgcgggtcgccatcttcgtgaacgtttcgaaaaagaaggcataaagggcgccttgatttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 200 - protein, 283 aa, Artificial Sequence
  laboratory generated variant based upon the ketoreductase of Candida magnoliae
MAENFSNVEYPAPPPAHTINETLQVLDLFKLNGKVASITGSSSGIGYALAEAFAQVGADVAIWYNSQDATGKAEALARKYGVKVKAYKANVSCSDAVKQAIEQQIKDFGRLDIVVANAGIPWTKGAYIDQDDDEHFDQVIDVDLKGVGYVAKHAGRHLRERFEKEGIKGALIFTASMSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 201 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatgagcattttgaccaggtgattgacgtcgacctgaaaggcgtaggctatgtagcaaaacaggcgggtcgccatcttcgtgaacgtttcgaaaaagaaggcagaaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 202 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDEHFDQVIDVDLKGVGYVAKQAGRHLRERFEKEGRKGALIFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 203 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataagcattttgaccaggtgattgacgtcgacctgaaaggcgtaggctatgtagcaaaacatgcgggtcgccatcttcgtgaacgtttcgaaaaagaaggcaaaaagggcgccttggtttttacggcttccacgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 204 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVIDVDLKGVGYVAKHAGRHLRERFEKEGKKGALVFTASTSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 205 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcaaaaagggcgccttggtttttacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgagagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 206 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGALVFTASVSGHIVNVPQFQATYNAAKAGVRHFAKSLAVEFAPFARVNSVSPGYINTEISDFVPRETQNKWWSLVPLGRGGETAELVGAYLFLASDAGSYATGTDIIVDGGYTLP

SEQ ID NO: 207 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaaaga

SEQ ID NO: 208 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGALVFTASMSGHIVNVPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 209 - DNA, 855 bp, Artificial Sequence
  laboratory generated variant based upon the ketoreductase of Candida magnoliae
  misc_feature: krh271
  CDS (1)..(855)
atggctaaaaactttagcaatgtcgaatatcctgccccgccgccagctcataccaaaaacgaaactctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccgcctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcagaaagggcgccttgatttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatcccctggctatattaataccggcatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 210 - protein, 283 aa, Artificial Sequence
  laboratory generated variant based upon the ketoreductase of Candida magnoliae
MAKNFSNVEYPAPPPAHTKNETLQVLDLFKLNGKVASITGSSSGIGYALAEAFAQVGADVAIWYNSQDATGKAEALAKKYGVKVKAYKANVSSSDAVKQTIEQQIKDFGRLDIVVANAGIPWTKGAYIDQDDDKHFDQVVDVDLKGVGYVAKHAGRHYRERFEKEGRKGALIFTASMSGHIVNVPQFQATYNAAKAGVRHFAKSLAVEFAPFARVNSVSPGYINTGISDFVPQETQNKWWSLVPLGRGGETAELVGAYLFLASDAGSYATGTDIIVDGGYTLP

SEQ ID NO: 211 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaagtggtagacgtcgacttcaagggcgtaggctatgtagcaaaatacgcgggtcgccattataaggaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgcggtaatga

SEQ ID NO: 212 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDFKGVGYVAKYAGRHYKERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLR

SEQ ID NO: 213 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaagaagggcgcattaatctgtacggcttccgtgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 214 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALICTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 215 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccaagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 216 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTKISDFVPQETQNKWWSLVPLGRGGETAELVGAYLFLASDAGSYATGTDIIVDGGYTLP

SEQ ID NO: 217 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtggcagttcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacacgcggtagagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatctaagggaacgtttcgaaaaagaaggcaaaaagggcgccttggtttttacggcttccgtgtcgggtcacatcgttaacgtcccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 218 - protein, 283 aa, Artificial Sequence
  laboratory generated variant based upon the ketoreductase of Candida magnoliae
MAKNFSNVEYPAPPPAHTKNESLQVLDLFKLNGKVASITGGSSGIGYALAEAFAQVGADVAIWYNSQDATGKAEALAKKYGVKVKAYKANVSSSDAVKHAVEQQIKDFGHLDIVVANAGIPWTKGAYIDQDDDKHFDQVVDVDLKGVGYVAKHAGRHLRERFEKEGKKGALVFTASVSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 219 - DNA, 855 bp, Artificial Sequence
  laboratory generated variant based upon the ketoreductase of Candida magnoliae
  CDS (1)..(855)
atggctaaaaactttagcaatgtcgaatatcctgccccaccgccagttcataccaaaaacgaatcactgcaggtactggatctgttcaaactgaacggcaaagtcgcgtctatcaccggtagcagctcaggcattggttacgcgctggccgaagcctttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 220 - protein, 283 aa, Artificial Sequence
  laboratory generated variant based upon the ketoreductase of Candida magnoliae
MAKNFSNVEYPAPPPVHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 221 - DNA, 855 bp, Artificial Sequence
  laboratory generated variant based upon the ketoreductase of Candida magnoliae
  CDS (1)..(855)
atggcgaagaactttagcaatgtcgaatatcctgccccgccgccaggtcataccaaaaacgaaagtctgcaggtactggatctgttcaaactgaacggcaaagtcgcatctatcaccggtggcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 222 - protein, 283 aa, Artificial Sequence
  laboratory generated variant based upon the ketoreductase of Candida magnoliae
MAKNFSNVEYPAPPPGHTKNESLQVLDLFKLNGKVASITGGSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 223 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaatga

SEQ ID NO: 224 - protein, 283 aa, Artificial Sequence; identical to SEQ ID NO: 96
  laboratory generated variant based upon the ketoreductase of Candida magnoliae

SEQ ID NO: 225 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcatcggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatttccgtgaacgtttcggaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 226 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFGKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 227 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaggcagaggccctggctaaaaaatatggcgtaaaagtcaaggcttataaagctgatgtcagctgcagtgaagcggtgaaactgactattgagcagcagatcaaggattttggccacctggacattgttgtggcgaacgcaggcatcccgtggactaagggtgcatacatcgatcaggatgacgataaacattttgaccaggtggtggacgtcaacctgaaaggcgtaggctatgtagcaaaacatgcgggtcgccatcttcgtgaacgtttcgaaaaagaaggcagaaagggcgccttgatttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 228 - protein, 283 aa, Artificial Sequence
  laboratory generated variant based upon the ketoreductase of Candida magnoliae
MAKNFSNVEYPAPPPAHTKNENLQVLDLFKLNGKVASITGSSSGIGYALAEAFAQVGADVAIWYNSQDATGKAEALAKKYGVKVKAYKADVSCSEAVKLTIEQQIKDFGHLDIVVANAGIPWTKGAYIDQDDDKHFDQVVDVNLKGVGYVAKHAGRHLRERFEKEGRKGALIFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 229 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcctttgcgcaggttggcgcggacgttgcgatctggtattacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccatcttcgtgaacgtttcgaaaaagaaggcagaaagggcgccttgatttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgaaatctctgatttcgtcccgcaaggaacacaaaataaatggtggagcttagttccattgggtcgtggtggggaaactgcggaattagttggtgcctacctgttcctggcaagtgatgcgggctcctacgccacgggcacagatattatcgtggatggcggctacacgctgccgtaatga

SEQ ID NO: 230 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYYSQDATGKAEALAKKYGVKVKAYKANVSSSDAVKQTIEQQIKDFGHLDIVVANAGIPWTKGAYIDQDDDKHFDQVIDVDLKGVGYVAKHAGRHLRERFEKEGRKGALIFTASMSGHIVNIPQFQATYNAAKAGVRHFAKSLAVEFAPFARVNSVSPGYINTEISDFVPQGTQNKWWSLVPLGRGGETAELVGAYLFLASDAGSYATGTDIIVDGGYTLP

SEQ ID NO: 231 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcgggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgaccaggatgacgataaacattttgaccaggtgattgacgtcgacctgaaaggcgtgggctatgtagcaaaacatgcgggtcgccattatcgtgaacgtttcgaaaaagaaggcaaaaagggcgccttggtttttacggcttccacatcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 232 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVIDVDLKGVGYVAKHAGRHYRERFEKEGKKGALVFTASTSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 233 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctgcagtgaagcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccattatcgtgaacgtttcgaaaaagaaggcaaaaagggcgccttggtttttacggcttccacatcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 234 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKADVSCSEAVKQTIEQQIKDFGHLDIVVANAGIPWTKGAYIDQDDDKHFDQVIDVDLKGVGYVAKHAGRHYRERFEKEGKKGALVFTASTSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 235 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctgcagtgaagcggtgaaacagactattgagcagcagatcaaggattttggccacctggacattgttgtggcgaacgcaggcatcccatggactaagggtgcatacatcgatcaggatgacgatgtgcattttgaccaggtgattgacgtcgacctgaaaggcgtaggctatgtagcaaaacatgcgggtcgccatcttcgtgaacgtttcgaaaaagaaggcagaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcgcgtgttaactctgtatctcctggctatattaataccgagatctctgatttcgtcccgcaagaaacacaaaataaatggtggagcttagttccattgggtcgtggtggggaaactgcggagttagttggtgcctacctgttcctggcaagtgatgcgggctcctacgccacgggcacagatattatcgtggatggcggctacacgctgccgtaatga

SEQ ID NO: 236 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKADVSCSEAVKQTIEQQIKDFGHLDIVVANAGIPWTKGAYIDQDDDVHFDQVIDVDLKGVGYVAKHAGRHLRERFEKEGRKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 237 - DNA, 855 bp, Artificial Sequence
  laboratory generated variant based upon the ketoreductase of Candida magnoliae
  CDS (1)..(855)
atggctgaaaactttagcaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctgcagtgaagcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccatcttcgtgaacgtttcgaaaaagaaggcagaaagggcgccttgatttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtctctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 238 - protein, 283 aa, Artificial Sequence
  laboratory generated variant based upon the ketoreductase of Candida magnoliae
MAENFSNVEYPAPPPAHTKNESLQVLDLFKLNGKVASITGSSSGIGYALAEAFAQVGADVAIWYNSQDATGKAEALAKKYGVKVKAYKADVSCSEAVKQTIEQQIKDFGHLDIVVANAGIPWTKGAYIDQDDDKHFDQVIDVDLKGVGYVAKHAGRHLRERFEKEGRKGALIFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 239 - DNA, 855 bp, Artificial Sequence
  laboratory generated variant based upon the ketoreductase of Candida magnoliae
  CDS (1)..(855)
atggctaaaaaccttagcaatgtcgaatatcctgccccgccgccagctcataccaaaaacgaaaatctgcaggtactggatctgttcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctgatgtcagctgtagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccatcttcgtgaacgtttcgaaaaagaaggcagaaagggcgccttgatttttacggcttccgtgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatattatcgtggatggcggctacacgctgccgtaatga

SEQ ID NO: 240 - protein, 283 aa, Artificial Sequence
  laboratory generated variant based upon the ketoreductase of Candida magnoliae
MAKNLSNVEYPAPPPAHTKNENLQVLDLFKLNGKVASITGSSSGIGYALAEAFAQVGADVAIWYNSQDATGKAEALAKKYGVKVKAYKADVSCSDAVKQTIEQQIKDFGHLDIVVANAGIPWTKGAYIDQDDDKHFDQVIDVDLKGVGYVAKHAGRHLRERFEKEGRKGALIFTASVSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 241 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaatga

SEQ ID NO: 242 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 243 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaggggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaatga

SEQ ID NO: 244 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTRGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 245 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaggtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgacgcgggctcctacgccacgggcacagatatcattgtggacggcggctacacgctgccgtaatga

SEQ ID NO: 246 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFARSLAVEFAPFARVNSVSPGYINTEISDFVPQETQNKWWSLVPLGRGGETAELVGAYLFLASDAGSYATGTDIIVDGGYTLP

SEQ ID NO: 247 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacactttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgacgcgggctcctacgccacgggcacagatatcattgtggatggcggctacacgctgccgtaa

SEQ ID NO: 248 - protein, 283 aa, Artificial Sequence; identical to SEQ ID NO: 242
  laboratory generated variant based upon the ketoreductase of Candida magnoliae

SEQ ID NO: 249 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtggacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 250 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRGRFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 251 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaatga

SEQ ID NO: 252 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 253 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 254 - protein, 283 aa, Artificial Sequence; identical to SEQ ID NO: 242
  laboratory generated variant based upon the ketoreductase of Candida magnoliae

SEQ ID NO: 255 - DNA, 855 bp, Artificial Sequence
  laboratory generated variant based upon the ketoreductase of Candida magnoliae
  CDS (1)..(855)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccatcttcgtgaacgtttcgaaaaagaaggcaaaaagggcgccttggtttttacggcttccacgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaatga

SEQ ID NO: 256 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVIDVDLKGVGYVAKHAGRHLRERFEKEGKKGALVFTASTSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 257 - DNA, 855 bp, Artificial Sequence; identical to SEQ ID NO: 223
  laboratory generated variant based upon the ketoreductase of Candida magnoliae
  CDS (1)..(855)

SEQ ID NO: 258 - protein, 283 aa, Artificial Sequence; identical to SEQ ID NO: 96
  laboratory generated variant based upon the ketoreductase of Candida magnoliae

SEQ ID NO: 259 - DNA, 855 bp, Artificial Sequence
  laboratory generated variant based upon the ketoreductase of Candida magnoliae
  CDS (1)..(855)
atggctaaaaactttagcaatgtcgaatatcctgccccgccgccagctcataccaaaaacgaatcactgcaggtactggatctattcaaactgaacggcaaagtcgcgtctatcaccggtagcagctcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaatga

SEQ ID NO: 260 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAAKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 261 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtaa

SEQ ID NO: 262 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 263 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcgtcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 264 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGVPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 265 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggttacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcgcagatatcattgtggacggcggctacacgctgccgtaa

SEQ ID NO: 266 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGYIVNVPQFQATYNAVKAGVRHFAKSLAVEFAPFARVNSVSPGYINTEISDFVPQETQNKWWSLVPLGRGGETAELVGAYLFLASDAGSYATGADIIVDGGYTLP

SEQ ID NO: 267 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtggcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgtcaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 268 - protein, 283 aa, Artificial Sequence; identical to SEQ ID NO: 96
  laboratory generated variant based upon the ketoreductase of Candida magnoliae

SEQ ID NO: 269 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggctggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgttccgaaaaagaaggcaaaaagggcgccttggtttttacggcttccatgtcgggtcacatcgttaacgtgccgcaatttcaggcgacctacaacgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 270 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQAGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERSEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 271 - DNA, 852 bp, Artificial Sequence
  laboratory generated variant based upon the ketoreductase of Candida magnoliae
  CDS (1)..(852)
atggctaaaaactttagcaacgtcgaataccctgccccgccgccggctcataccaaaaacgaatcactgcaggtactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtaa

SEQ ID NO: 272 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVIDVDLKGVGYVAKHAGRHFRERFEKEGKKGALVFTASMSGHIVNVPQFQATYNAAKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 273 - DNA, 852 bp, Artificial Sequence
  laboratory generated variant based upon the ketoreductase of Candida magnoliae
  CDS (1)..(852)
atggctaaaaactttagcaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 274 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 275 - DNA, 852 bp, Artificial Sequence
  laboratory generated variant based upon the ketoreductase of Candida magnoliae
  CDS (1)..(852)
atggctaaaaactttagcaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagtcccattgggtcgtggtggggaaactgcggaattagttggtgcctacctgttcctggcaagtgatgcgggctcctacgccacgggcacagatatcattgtggatggcggctacacgctgccgtaa

SEQ ID NO: 276 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 277 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagaccattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccacgtcgggtcacatcgttaacattccgcaatttcaggcgacctacaacgcggtcaaggcaggcgtgcgccatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagtcggtgcctacctgttcctggcaagtgatgcgggctcctacgccacgggcacggatatcattgtggacggcggctacacgctgccgtaa

SEQ ID NO: 278 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASTSGHIVNIPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 279 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccggctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcaggtcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccacgtcgggtcacatcgttaacattccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacggatatcattgtggatggcggctacacgctgccgtaa

SEQ ID NO: 280 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSYAVKQTIEQQVKDFGHLDIVVANAGIPWTKGAYIDQDDDKHFDQVVDVDLKGVGYVAKHAGRHFRERFEKEGKKGALVFTASTSGHIVNIPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 281 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagatggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 282 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKDGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 283 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggttttcacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaaggaacacaaaataaatggtggagcttagttccattgggtcgtggtggggaaactgcggaattagttggcgcctacctgttcctggcaagtgatgcgggctcctacgccacgggcacagatatcattgtggatggcggctacacgctgccgtaa

SEQ ID NO: 284 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQGTQNKWWSLVPLGRGGETAELVGAYLFLASDAGSYATGTDIIVDGGYTLP

SEQ ID NO: 285 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcactggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgatagacattttgaccaggtggtggacgtcgacctgaaaggcgtaggctatgtagcaaaacatgcgggtcgccattttcgtggacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 286 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDRHFDQVVDVDLKGVGYVAKHAGRHFRGRFEKEGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 287 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcaaaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 288 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAKALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 289 - DNA, 852 bp, Artificial Sequence
  laboratory generated variant based upon the ketoreductase of Candida magnoliae
  CDS (1)..(852)
atggctaaaaactttagcaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtggacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 290 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRGRFEKEGKKGALVFTASMSGHIVNVPQFQATYNAAKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 291 - DNA, 852 bp, Artificial Sequence
  laboratory generated variant based upon the ketoreductase of Candida magnoliae
  CDS (1)..(852)
atggctaaaaactttagcaatgtcgaataccccgccccgccgccagctcataccaaaaacgaatcactgcaggtactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattagtaccgagatctctgatttcgtcccgcaagaaaaacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtaa

SEQ ID NO: 292 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVIDVDLKGVGYVAKHAGRHFRERFEKEGKKGALVFTASMSGHIVNVPQFQATYNAVKAGVRHFAKSLAVEFAPFARVNSVSPGYISTEISDFVPQEKQNKWWSLVPLGRGGETAELVGAYLFLASDAGSYATGTDIIVDGGYTLP

SEQ ID NO: 293 - DNA, 852 bp, Artificial Sequence
  laboratory generated variant based upon the ketoreductase of Candida magnoliae
  CDS (1)..(852)
atggctaaaaactttagcaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagaccaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgctattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 294 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQTKDFGHLDIVVANAGIPWTKGAYIDQDDDKHFDQVVDVDLKGVGYVAKHAGRYFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 295 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactatcgagcagcagatcaaggattttggccacctggacattgttgtggcgaacgcaggcatcccatggactaagggtgcgtacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccacgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtaa

SEQ ID NO: 296 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASTSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 297 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcatgccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccatgatgccacaggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgccccgcaagaaacacaaaataaatggtggagcttagttccattgggtcgtggtggggaaactgcggaattagttggcgcctacctgttcctggcaagtgatgcgggctcctacgccacgggcacagatatcattgtggacggcggctacacgctgccgtaa

SEQ ID NO: 298 - protein, 283 aa, Artificial Sequence
  laboratory generated variant based upon the ketoreductase of Candida magnoliae
MAKNFSNVEYPAPPPAHAKNESLQVLDLFKLNGKVASITGSSSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFAPQETQNKWWSLVPLGRGGETAELVGAYLFLASDAGSYATGTDIIVDGGYTLP

SEQ ID NO: 299 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctattcaaactgaacggcaaagtcgcgtctatcaccggtagcagctcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgccccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 300 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGALVFTASMSGHIVNVPQFQATYNAAKAGVRHFAKSLAVEFAPFARVNSVSPGYINTEISDFAPQETQNKWWSLVPLGRGGETAELVGAYLFLASDAGSYATGTDIIVDGGYTLP

SEQ ID NO: 301 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 302 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHLRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 303 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtaa

SEQ ID NO: 304 - protein, 283 aa, Artificial Sequence; identical to SEQ ID NO: 242
  laboratory generated variant based upon the ketoreductase of Candida magnoliae

SEQ ID NO: 305 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgagaaagaaggcaaaaagggcgccttggtttttacggcttccacgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgctttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 306 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASTSGHIVNVPQFQATYNAAKAGVRHFAKSLAVEFAPFARVNSVSPGYINTEISAFVPQETQNKWWSLVPLGRGGETAELVGAYLFLASDAGSYATGTDIIVDGGYTLP

SEQ ID NO: 307 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcatgccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattatcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcgttgtggacggcggctacacgctgccgtaa

SEQ ID NO: 308 - protein, 283 aa, Artificial Sequence
  laboratory generated variant based upon the ketoreductase of Candida magnoliae
MAKNFSNVEYPAPPPAHAKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHYRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 309 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcagctcaggccttggttacgcgctggccgaagcttttgcgcaggtcggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtggacgtttcgaaaaagaaggcaaaaagggcgccttggtttttacggcttccatgtcgggtcacatcgttaacgtgccgcaatttcaggcggcctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatccttgtggacggcggctacacgctgccgtaa

SEQ ID NO: 310 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGLGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRGRFEKEGKKGALVFTASMSGHIVNVPQFQAAYNAAKAGVRHFAKSLAVEFAPFARVNSVSPGYINTEISDFVPQETQNKWWSLVPLGRGGETAELVGAYLFLASDAGSYATGTDILVDGGYTLP

SEQ ID NO: 311 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgcagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataagtggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 312 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYAAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 313 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacaggctattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaggaaggcaaaaagggcgccttggtttttacggcttccacgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 314 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQAIEQQIKDFGHLDIVVANAGIPWTKGAYIDQDDDKHFDQVVDVDLKGVGYVAKHAGRHFRERFEKEGKKGALVFTASTSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 315 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtatagcagccatgatgccaccggtaaagcagaggccctggctaaaaaatacggcgtaaaagtcaaggcttataaagctaatgtcagctcgagttatgcggtgaaacagactattgagcagcagatcaaggattttggccacctggacattgttgtggcgaacgcaggcatcccatggactaagggtgcatacatcgatcaggatgacgataaacattttgacctggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcgagaaaaacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 316 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYSSHDATGKAEALAKKYGVKVKAYKANVSSSYAVKQTIEQQIKDFGHLDIVVANAGIPWTKGAYIDQDDDKHFDLVVDVDLKGVGYVAKHAGRHFRERFEKEGKKGALVFTASMSGHIVNVPQFQATYNAAKAGVRHFAKSLAVEFAPFARVNSVSPGYINTEISDFVPREKQNKWWSLVPLGRGGETAELVGAYLFLASDAGSYATGTDIIVDGGYTLP

SEQ ID NO: 317 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaagacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 318 - protein, 283 aa, Artificial Sequence
  laboratory generated variant based upon the ketoreductase of Candida magnoliae
MAKNFSNVEYPAPPPAHTKDESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 319 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcagggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgtacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 320 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIRDFGHLDIVVANAGIPWTKGAYIDQDDDKHFDQVVDVDLKGVGYVAKHAGRHFRVRFEKEGKKGALVFTASMSGHIVNVPQFQATYNAAKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 321 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 322 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 323 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaagacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcgaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 324 - protein, 283 aa, Artificial Sequence
  laboratory generated variant based upon the ketoreductase of Candida magnoliae
MAKNFSNVEYPAPPPAHTKDESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 325 - DNA, 852 bp, Artificial Sequencej
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccatcttcgtgaacgttacgaaaaagaaggcaaaaagggcgccttggtttttacggcttccatgtcgggtcacatcgttaacgtgccgcaatttcaggcgacctacaatgcggccaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgacgcgggctcctacgccacgggcacagatatcattgtggatggcggctacacgctgccgtaa

SEQ ID NO: 326 - protein, 283 aa, Artificial Sequencej
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHLRERYEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 327 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggatttcggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 328 - protein, 283 aa, Artificial Sequence; identical to SEQ ID NO: 96
  laboratory generated variant based upon the ketoreductase of Candida magnoliae

SEQ ID NO: 329 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcacttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagctggtgcctacctgttcctggcaagtgatgcgggctcctacgccacgggcacagatatcattgtggacggcggctacacgctgccgtaa

SEQ ID NO: 330 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELAGAYLFLASDAGSYATGTDIIVDGGYTLP

SEQ ID NO: 331 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaatataaatggtggagcttggttccattgggccgtggtggggaaactgcggaattagttggtgcctacctgttcctggcaagtgatgcgggctcctacgccacgggcacagatatcattgtggacggcggctacacgctgccgtaa

SEQ ID NO: 332 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQYKWWSLVPLGRGGETAELVGAYLFLASDAGSYATGTDIIVDGGYTLP

SEQ ID NO: 333 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcctccatgtcgggtcacatcgttaacgtgccgcaatttcaggcgacctacaatgcggttaaggcaggcgtgcgtcacttcgcaaagtccctggccgtggaatttgctcctttcgcacgtgttaactctgtatctcctggctatattaataccgagatctctgatttcgtcccgcaagagacacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtaa

SEQ ID NO: 334 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 335 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggcactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccgtggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 336 - protein, 283 aa, Artificial Sequence
  laboratory generated variant based upon the ketoreductase of Candida magnoliae
MAKNFSNVEYPAPPPAHTKNESLQALDLFKLNGKVASITGSNSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 337 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgtcgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtggacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtagaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 338 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRGRFEKEGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 339 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcatgccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcattgtggacggcggctacacgctgccgtaa

SEQ ID NO: 340 - protein, 283 aa, Artificial Sequence
  laboratory generated variant based upon the ketoreductase of Candida magnoliae
MAKNFSNVEYPAPPPAHAKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 341 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaagacgaatcactgcaggtactggatctgttcaaactgaacggcaaagtcgcgtctatcaccggtagcagctcaggcattggttacgcgctggccgaagcctttgcgcaggttggcgcagacgttgcgatctggtataacagccaggatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtgattgacgtcgacctgaaaggcgtaggctatgtagcaaaacatgcgggtcgccattatcgtgaacgtttcgaaaaagaaggcataaagggcgccttgatttttacggcttccgtgtcgggtcacatcgttaacattccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 342 - protein, 283 aa, Artificial Sequence
  laboratory generated variant based upon the ketoreductase of Candida magnoliae
MAKNFSNVEYPAPPPAHTKDESLQVLDLFKLNGKVASITGSSSGIGYALAEAFAQVGADVAIWYNSQDATGKAEALAKKYGVKVKAYKANVSSSDAVKQTIEQQIKDFGHLDIVVANAGIPWTKGAYIDQDDDKHFDQVIDVDLKGVGYVAKHAGRHYRERFEKEGIKGALIFTASVSGHIVNIPQFQATYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 343 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtaa

SEQ ID NO: 344 - protein, 283 aa, Artificial Sequence; identical to SEQ ID NO: 242
  laboratory generated variant based upon the ketoreductase of Candida magnoliae

SEQ ID NO: 345 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcaccgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacattgttgtggcgaacgcaggcatcccgtggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcggcctacaatgcggccaaggcaggcgtgcgtcacttcgcaaagtccctggccgtggagtttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 346 - protein, 283 aa, Artificial Sequence
  laboratory generated variant based upon the ketoreductase of Candida magnoliae
MAKNFSNVEYPAPPPAHTKNESPQVLDLFKLNGKVASITGSNSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKEGKKGALVFTASMSGHIVNVPQFQAAYNAAKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 347 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagttatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattagtaccgagatctctgatttcgtcccgcaagaaacacaaaataaatggtggagcttagttccattgggtcgcggtggggaaactgcggaattagttggtgcctacctgttcctggcaagtgatgcgggctcctacgccacgggcacagatatcattgtggacggcggctacacgctgccgtaa

SEQ ID NO: 348 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYNSHDATGKAEALAKKYGVKVKAYKANVSSSYAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYISTEISDFVPQETQNKWWSLVPLGRGGETAELVGAYLFLASDAGSYATGTDIIVDGGYTLP

SEQ ID NO: 349 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcagctcaggcattggttacgcgctggccgaagcttttgcgcaggttggcgcagacgttgcgatctggtatgacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcacttcgcaaagtccctggccgtggaatttgctcctttcgcacgtgttaactctgtatctcctggctatattaataccgagatctctgatttcgtcccgcaagagacacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtaa

SEQ ID NO: 350 - protein, 283 aa, Artificial Sequence
  laboratory generated variant based upon the ketoreductase of Candida magnoliae
MAKNFSNVEYPAPPPAHTKNESLQVLDLFKLNGKVASITGSSSGIGYALAEAFAQVGADVAIWYDSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 351 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtatgacagccatgatgccaccggtaaagcagaggccctggctaaaagatatggcgtaaaagtcaaggcttataaagctaatgtcagctcgagtgatgcggtgaaacagactattgagcagcagatcaaggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgccatttcgcaaagtccctggccgtggaatttgctcctttcgcacgtgttaactctgtatctcctggctatattaataccgagatctctgatttcgtcccgcaagaaacacaaaataaatggtggagcttagttccattgggtcgtggtggggaaactgcggaattagttggtgcctacctgttcctggcaagtgatgcgggctcctacgccacgggcacagatatcatcgtggatggcggctacacgctgccgtaa

SEQ ID NO: 352 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYDSHDATGKAEALAKRYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 353 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacagaataaatggtggagcttagttccattgggccgtggcggggaaactgcggaattagttggtgcctacctgttcctggcaagtgatgcgggctcctacgccacgggcacagatatcattgtggacggcggctacacgctgccgtaa

SEQ ID NO: 354 - protein, 283 aa, Artificial Sequence; identical to SEQ ID NO: 262
  laboratory generated variant based upon the ketoreductase of Candida magnoliae

SEQ ID NO: 355 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacaagcgggtcgccattttcgtgaacgtttcgaaaaagaaggcaaaaagggcgccttggtttttacggcttccatgtcgggtcacatcgttaacattccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 356 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKQAGRHFRERFEKEGKKGALVFTASMSGHIVNIPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 357 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacaaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctagaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 358 - protein, 283 aa, Artificial Sequence
  laboratory generated variant based upon the ketoreductase of Candida magnoliae
MAKNFSNVEYPAPPPAHTKNKSLQVLDLFKLNGKVASITGSNSGIGYALAEAFAQVGADVAIWYNSHDATGKAEALARKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 359 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaagctgaacggcaaagtcgcgtctatcaccggtagcaactcaggcattggttacgcgctggccgaagctttcgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcaaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 360 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFKKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 361 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacattccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 362 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNIPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 363 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggccgccattttcgtgaacgtttcgaaaaagaaggcaaaaagggcgccttggtttttacggcttccatgtcgggtcacatcgttaacattccgcaatttcaggcgacctacaatgcggtcaaggcaggcgtgcgtcatttcgcaaagtccctggccgtggaatttgctcctttcgcacgtgttaactctgtatctcctggctatattaataccgagatctctgattttgtcccgcaagaaaaacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 364 - protein, 283 aa, Artificial Sequence; identical to SEQ ID NO: 362
  laboratory generated variant based upon the ketoreductase of Candida magnoliae

SEQ ID NO: 365 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacattccgcaatttcaggcgacctacaatgcggtcaaggcaggcgtgcgtcatttcgcaaagtccctggccgtggagtttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggacggcggctacacgctgccgtag

SEQ ID NO: 366 - protein, 283 aa, Artificial Sequence; identical to SEQ ID NO: 362
  laboratory generated variant based upon the ketoreductase of Candida magnoliae

SEQ ID NO: 367 - DNA, 852 bp, Artificial Sequence
  laboratory generated variant based upon the ketoreductase of Candida magnoliae
  CDS (1)..(852)
atggctaaaaacttttccaaggtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 368 - protein, 283 aa, Artificial Sequence
  laboratory generated variant based upon the ketoreductase of Candida magnoliae
MAKNFSKVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 369 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcggaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 370 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFGKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 371 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcggtcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcctagttccattgggccgtggcggggaaactgcggaattagttggtgcctacctgttcctggcaagtgatgcgggctcctacgccacgggcacagatatcattgtggacggcggctacacgctgccgtag

SEQ ID NO: 372 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIGQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 373 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcaatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 374 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYINQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 375 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtggtgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 376 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSGAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 377 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcagggtgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 378 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQGDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 379 - DNA, 852 bp, Artificial Sequence
  laboratory generated variant based upon the ketoreductase of Candida magnoliae
  CDS (1)..(852)
atggctaaaaacttttccaatgtcgaatatccagccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcaggggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaagggaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 380 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAGALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 381 - DNA, 852 bp, Artificial Sequence
  laboratory generated variant based upon the ketoreductase of Candida magnoliae
  CDS (1)..(852)
atggctaaaaacttttccaatgtcaaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 382 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 383 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagttcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttggccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgcgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 384 - protein, 283 aa, Artificial Sequence
  laboratory generated variant based upon the ketoreductase of Candida magnoliae
MAKNFSNVEYPAPPPVHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFGQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 385 - DNA, 852 bp, Artificial Sequence; identical to SEQ ID NO: 377
  laboratory generated variant based upon the ketoreductase of Candida magnoliae
  CDS (1)..(852)

SEQ ID NO: 386 - protein, 283 aa, Artificial Sequence; identical to SEQ ID NO: 378
  laboratory generated variant based upon the ketoreductase of Candida magnoliae

SEQ ID NO: 387 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaggcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggttgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 388 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQVDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 389 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcgtaccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 390 - protein, 283 aa, Artificial Sequence
  laboratory generated variant based upon the ketoreductase of Candida magnoliae
MAKNFSNVEYPAPPPARTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 391 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttggccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 392 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFGQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 393 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcgagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 394 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPRETQNKWWSLVPLGRGGETAELVGAYLFLASDAGSYATGTDIIVDGGYTLP

SEQ ID NO: 395 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttggccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacattccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 396 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFGQVVDVDLKGVGYVAKHAGRHFRERFEKEGKKGALVFTASMSGHIVNIPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 397 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgttgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaaggaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcgagtgatgcgggctcctacgccacgggcacagatatcattgtggacggcggctacacgctgccgtag

SEQ ID NO: 398 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSVAVKQTIEQQIKDFGHLDIVVANAGIPWTKGAYIDQDDDKHFDQVVDVDLKGVGYVAKHAGRHFRERFEKGGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 399 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcagggtgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 400 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQGDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 401 - DNA, 852 bp, Artificial Sequence; identical to SEQ ID NO: 319
  laboratory generated variant based upon the ketoreductase of Candida magnoliae
  CDS (1)..(852)

SEQ ID NO: 402 - protein, 283 aa, Artificial Sequence; identical to SEQ ID NO: 320
  laboratory generated variant based upon the ketoreductase of Candida magnoliae

SEQ ID NO: 403 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccacgacgccaccggtaaagcagaggccctggctaaaaaatatggcgtaaaagtcaaggcttataaggctaatgtcagctcgagtgatgcggtgaaacagactattgagcagcagatcagggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgtacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 404 - protein, 283 aa, Artificial Sequence; identical to SEQ ID NO: 320
  laboratory generated variant based upon the ketoreductase of Candida magnoliae

SEQ ID NO: 405 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgagacagactattgagcagcagatcaaggattttggccacctggacatagttgtggcgaacgcaggcatcccatggactaagggtgcatacatcgatcaggttgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 406 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVRQTIEQQIKDFGHLDIVVANAGIPWTKGAYIDQVDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 407 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaagcagactattgagcggcagatcaaggattttggccacctggacatagttgtggcgaacgcaggcatcccatggactaagggtgcatacatcgaccaggatgacgataaacattttgaccaggtggtggacgtcgacctgaaaggcgtaggctatgtagcaaaacatgcgggtcgccattttcgtgaacgtttcgaaaaagaaggcaaaaagggcgccttggttttcacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 408 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIERQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 409 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggataacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtgtctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 410 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDNDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 411 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacaaatcactgcaggtactggatctgttcaaactggacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 412 - protein, 283 aa, Artificial Sequence
  laboratory generated variant based upon the ketoreductase of Candida magnoliae
MAKNFSNVEYPAPPPAHTKNKSLQVLDLFKLDGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 413 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaggcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaaaaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 414 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKKGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 415 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcagggtgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggtggggaaactgcggaattagttggtgcctacctgttcctggcaagtgatgcgggctcctacgccacgggcacagatatcgttgtggacggcggctacacgctgccgtag

SEQ ID NO: 416 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQGDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 417 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacggactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 418 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKRTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 419 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcaggggccctggctaaaaaatatggcgtaaaagtcaaggcttataaagctaatgtcagttcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcgagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 420 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAGALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPRETQNKWWSLVPLGRGGETAELVGAYLFLASDAGSYATGTDIIVDGGYTLP

SEQ ID NO: 421 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgtacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 422 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRVRFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 423 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcgcgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 424 - protein, 283 aa, Artificial Sequence; identical to SEQ ID NO: 262
  laboratory generated variant based upon the ketoreductase of Candida magnoliae

SEQ ID NO: 425 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgtacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 426 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRVRFEKEGKKGALVFTASMSGHIVNVPQFQATYNAAKAGVRHFAKSLAVEFAPFARVNSVSPGYINTEISDFVPQEKQNKWWSLVPLGRGGETAELVGAYLFLASDAGSYATGTDIIVDGGYTLP

SEQ ID NO: 427 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatggtgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 428 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHGATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 429 - DNA, 852 bp, Artificial Sequence
  laboratory generated variant based upon the ketoreductase of Candida magnoliae
  CDS (1)..(852)
atggctaaaaacttttccaatgtcgaatatcctgccccgccaccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaggtcaaggcttataaagctaatgtcagctcgagtgatgcggtgaaacagactattgagcagcagatcagggattttggccacctggacattgttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgtacgtttcgaaaaagaaggcaaaaagggcgccttggtttttacggcttccatgtcgggtcacatcgttaacgtgccgcaatttcaggcgacctacaatgcggccaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 430 - protein, 283 aa, Artificial Sequence; identical to SEQ ID NO: 320
  laboratory generated variant based upon the ketoreductase of Candida magnoliae

SEQ ID NO: 431 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatggcgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 432 - protein, 283 aa, Artificial Sequence; identical to SEQ ID NO: 428
  laboratory generated variant based upon the ketoreductase of Candida magnoliae

SEQ ID NO: 433 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcaaaggccctagctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 434 - protein, 283 aa, Artificial Sequence; identical to SEQ ID NO: 288
  laboratory generated variant based upon the ketoreductase of Candida magnoliae

SEQ ID NO: 435 - DNA, 852 bp, Artificial Sequence
  laboratory generated variant based upon the ketoreductase of Candida magnoliae
  CDS (1)..(852)
atggctaaaaacttttccaatgtcaaatatcctgccccgccgccagctcataccaaaaacgaatcactgcaggtactggatctgttcaaactgaacggcaaagtcgcgtctatcaccggtggcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 436 - protein, 283 aa, Artificial Sequence
  laboratory generated variant based upon the ketoreductase of Candida magnoliae
MAKNFSNVKYPAPPPAHTKNESLQVLDLFKLNGKVASITGGNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 437 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 438 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 439 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgcttcgaaaaagaaggcaaaaagggcgccttggtttttacggcttccatgtcgggtcacatcgttaacattccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 440 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNIPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 441 - DNA, 852 bp, Artificial Sequence
  laboratory generated variant based upon the ketoreductase of Candida magnoliae
  CDS (1)..(852)
atggctaaaaacttttccaatgtcgaatatcctgccccgccaccagctcataccaaaaacgaatcactgcaggtactggatctgttcaaactgaacggcaaagtcgcgtctatcaccggtagcaactcaggcattggttacgcgctggccgaagcttttgcgcaggtcggcgcagacgttgcgatctggtacaacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagtcgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggccgtggtggggaaactgcggaattagttggtgcctacctgttcctggcaagtgatgcgggctcctacgccacgggcacagatatcattgtggatggcggctacacgctgccgtag

SEQ ID NO: 442 - protein, 283 aa, Artificial Sequence; identical to SEQ ID NO: 262
  laboratory generated variant based upon the ketoreductase of Candida magnoliae

SEQ ID NO: 443 - DNA, 852 bp, Artificial Sequence; identical to SEQ ID NO: 377
  laboratory generated variant based upon the ketoreductase of Candida magnoliae
  CDS (1)..(852)

SEQ ID NO: 444 - protein, 283 aa, Artificial Sequence; identical to SEQ ID NO: 378
  laboratory generated variant based upon the ketoreductase of Candida magnoliae

SEQ ID NO: 445 - DNA, 852 bp, Artificial Sequence
  laboratory generated variant based upon the ketoreductase of Candida magnoliae
  CDS (1)..(852)
atggctaaaaacttttccaatgtcgagtatcctgccccgccgccagctcataccaaaaacgaatcactgcaggtactggatctgttcaaactgaacggcaaagtcgcgtctatcaccggtggcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacattgatcagggtgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 446 - protein, 283 aa, Artificial Sequence
  laboratory generated variant based upon the ketoreductase of Candida magnoliae
MAKNFSNVEYPAPPPAHTKNESLQVLDLFKLNGKVASITGGNSGIGYALAEAFAQVGADVAIWYNSHDATGKAEALAKKYGVKVKAYKANVSSSDAVKQTIEQQIKDFGHLDIVVANAGIPWTKGAYIDQGDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 447 - DNA, 852 bp, Artificial Sequence
  laboratory generated variant based upon the ketoreductase of Candida magnoliae
  CDS (1)..(852)
atggctaaaaacttttccaatgtcaaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctgatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 448 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKADVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 449 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatgaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 450 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNEWWSLVPLGRGGETAELVGAYLFLASDAGSYATGTDIIVDGGYTLP

SEQ ID NO: 451 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 452 - protein, 283 aa, Artificial Sequence; identical to SEQ ID NO: 242
  laboratory generated variant based upon the ketoreductase of Candida magnoliae

SEQ ID NO: 453 - DNA, 852 bp, Artificial Sequence
  laboratory generated variant based upon the ketoreductase of Candida magnoliae
  CDS (1)..(852)
atggctaaaaacttttccaatgtcgaatatccagccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaaggaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 454 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQGTQNKWWSLVPLGRGGETAELVGAYLFLASDAGSYATGTDIIVDGGYTLP

SEQ ID NO: 455 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaggctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttctatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaagcacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 456 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQEAQNKWWSLVPLGRGGETAELVGAYLFLASDAGSYATGTDIIVDGGYTLP

SEQ ID NO: 457 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagccaatgtcagctcgagtgatgcggtgaaacaggctattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggagtttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 458 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQAIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 459 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaaaacaaaataaatggtggagcttagttccattgggtcgtggtggggaaactgcggaattagttggtgcctacctgttcctggcaagtgatgcgggctcctacgccacgggcacagatatcattgtggatggcggctacacgctgccgtaa

SEQ ID NO: 460 - protein, 283 aa, Artificial Sequence; identical to SEQ ID NO: 262
  laboratory generated variant based upon the ketoreductase of Candida magnoliae

SEQ ID NO: 461 - DNA, 852 bp, Artificial Sequence
  laboratory generated variant based upon the ketoreductase of Candida magnoliae
  CDS (1)..(852)
atggctaaaaacttttccaatgtcgaatatcctgccctgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 462 - protein, 283 aa, Artificial Sequence
  laboratory generated variant based upon the ketoreductase of Candida magnoliae
MAKNFSNVEYPALPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 463 - DNA, 852 bp, Artificial Sequence; identical to SEQ ID NO: 377
  laboratory generated variant based upon the ketoreductase of Candida magnoliae
  CDS (1)..(852)

SEQ ID NO: 464 - protein, 283 aa, Artificial Sequence; identical to SEQ ID NO: 378
  laboratory generated variant based upon the ketoreductase of Candida magnoliae

SEQ ID NO: 465 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcgggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcagggtgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggcgcctacctgttcctggcaagtgatgcgggctcctacgccacgggcacagatatcattgtggacggcggctacacgctgccgtag

SEQ ID NO: 466 - protein, 283 aa, Artificial Sequence
  laboratory generated variant based upon the ketoreductase of Candida magnoliae
MAKNFSNVEYPAPPPAHTKNESLRVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQGDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 467 - DNA, 852 bp, Artificial sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaagcagactattgagcggcagatcaaggattttggccacctggacatagttgtggcgaacgcaggcatcccatggactaagggtgcatacatcgaccaggatgacgataaacattttaaccaggtggtggacgtcgacctgaaaggcgtaggctatgtagcaaaacatgcgggtcgccattttcgtgaacgtttcgaaaaagaaggcaaaaagggcgccttggttttcacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 468 - protein, 283 aa, Artificial sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIERQIKDFGHLDIVVANAGIPWTKGAYIDQDDDKHFNQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 469 - DNA, 852 bp, Artificial Sequence
  laboratory generated variant based upon the ketoreductase of Candida magnoliae
  CDS (1)..(852)
atggctaaaaacttttccaatgtcaaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcagggtgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcgagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 470 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQGDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPRETQNKWWSLVPLGRGGETAELVGAYLFLASDAGSYATGTDIIVDGGYTLP

SEQ ID NO: 471 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacaaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctagaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaagagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 472 - protein, 283 aa, Artificial Sequence
  laboratory generated variant based upon the ketoreductase of Candida magnoliae
MAKNFSNVEYPAPPPAHTKNKSLQVLDLFKLNGKVASITGSNSGIGYALAEAFAQVGADVAIWYNSHDATGKAEALARKYGVKVKAYKANVSSSDAVKQTIEQQIKDFGHLDIVVANAGIPWTKGAYIDQDDDKHFDQVVDVDLKGVGYVAKHAGRHFRERFEREGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 473 - DNA, 852 bp, Artificial Sequence; identical to SEQ ID NO: 447
  laboratory generated variant based upon the ketoreductase of Candida magnoliae
  CDS (1)..(852)

SEQ ID NO: 474 - protein, 283 aa, Artificial Sequence; identical to SEQ ID NO: 448
  laboratory generated variant based upon the ketoreductase of Candida magnoliae

SEQ ID NO: 475 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtccatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctgatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcgggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 476 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKADVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 477 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacaaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccataatgccaccggtaaagcagaggccctggctagaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 478 - protein, 283 aa, Artificial Sequence
  laboratory generated variant based upon the ketoreductase of Candida magnoliae
MAKNFSNVEYPAPPPAHTKNKSLQVLDLFKLNGKVASITGSNSGIGYALAEAFAQVGADVAIWYNSHNATGKAEALARKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 479 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacaaatcactgcaggtactggatctgttcaaactgaacggcaaagtcgcgtctatcaccggtagcaactcaggcattggttatgcgctggccgaagcttttgcgcaggttggcgcagacgttgcgatctggtataacagccatgatgccaccggtaaagcagaggccctggctaaaaaatatggcgtaaaagtcaaggcttataaagctgatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 480 - protein, 283 aa, Artificial Sequence
  laboratory generated variant based upon the ketoreductase of Candida magnoliae
MAKNFSNVEYPAPPPAHTKNKSLQVLDLFKLNGKVASITGSNSGIGYALAEAFAQVGADVAIWYNSHDATGKAEALAKKYGVKVKAYKADVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 481 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaactgactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgtttctggcaagtgatgcgggctcctacgccacgggcacggatatcattgtggacggcggctacacgctgccgtag

SEQ ID NO: 482 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKLTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 483 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttaaccaggtggtggacgtcaacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 484 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFNQVVDVNLKGVGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 485 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 486 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 487 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataaccgccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatctcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 488 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNRHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHLAKSLAVEFAPFARVNSVSPGYINTEISDFVPQETQNRWWSLVPLGRGGETAELVGAYLFLASDAGSYATGTDIIVDGGYTLP

SEQ ID NO: 489 - DNA, 852 bp, Artificial Sequence
  laboratory generated variant based upon the ketoreductase of Candida magnoliae
  CDS (1)..(852)
atggctaaaaacttttccaatgtcgaatatcctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatgaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 490 - protein, 283 aa, Artificial Sequence; identical to SEQ ID NO: 450
  laboratory generated variant based upon the ketoreductase of Candida magnoliae

SEQ ID NO: 491 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaggtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 492 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFARSLAVEFAPFARVNSVSPGYINTEISDFVPQETQNRWWSLVPLGRGGETAELVGAYLFLASDAGSYATGTDIIVDGGYTLP

SEQ ID NO: 493 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaggcagaggccctggctagaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 494 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALARKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 495 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcctttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcggcctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 496 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQAAYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 497 - DNA, 852 bp, Artificial Sequence
  laboratory generated variant based upon the ketoreductase of Candida magnoliae
  CDS (1)..(852)
atggctaaaaacttttccaatgtcgaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 498 - protein, 283 aa, Artificial Sequence
  laboratory generated variant based upon the ketoreductase of Candida magnoliae
MAKNFSNVEYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 499 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaagcacaaaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 500 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQEAQNKWWSLVPLGRGGETAELVGAYLFLASDAGSYATGTDIIVDGGYTLP

SEQ ID NO: 501 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 502 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 503 - DNA, 852 bp, Artificial Sequence
  laboratory generated variant based upon the ketoreductase of Candida magnoliae
  CDS (1)..(852)
atggctaaaaacttttccaatgtcgaatatcctgcaccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagatgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcggcctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 504 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQAAYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 505 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggttgacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcggcctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 506 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQAAYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 507 - DNA, 852 bp, Artificial Sequence
  laboratory generated variant based upon the ketoreductase of Candida magnoliae
  CDS (1)..(852)
atggctaaaaacttttccaatgtcaaataccctgccccgccgccagctcataccaaaaacgaatcactgcaggtactggatctattcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttaaccaggtggtggacgtcaacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 508 - protein, 283 aa, Artificial Sequence
  laboratory generated variant based upon the ketoreductase of Candida magnoliae
MAKNFSNVKYPAPPPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFNQVVDVNLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 509 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaagcgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaagggcgtaggctatgtagcaaaacatgcgggtcgccattttcgtgaacgtttcgaaaaagaaggcaaaaagggcgccttggtttttacggcttccatgtcgggtcacatcgttaacgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 510 - protein, 283 aa, Artificial Sequence
  laboratory generated variant based upon the ketoreductase of Candida magnoliae
MAKNFSNVEYPAPAPAHTKSESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 511 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggaaacacaaaataaatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 512 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 513 - DNA, 852 bp, Artificial Sequence
  laboratory generated variant based upon the ketoreductase of Candida magnoliae
  CDS (1)..(852)
atggctaaaaacttttccaatgtcgaataccctgccccaccgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 514 - protein, 283 aa, Artificial Sequence; identical to SEQ ID NO: 498
  laboratory generated variant based upon the ketoreductase of Candida magnoliae

SEQ ID NO: 515 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccgataaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 516 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATDKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 517 - DNA, 852 bp, Artificial Sequence
  laboratory generated variant based upon the ketoreductase of Candida magnoliae
  CDS (1)..(852)
atggctaaaaacttttccaatgtcgaataccctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggaaacacagaatagatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 518 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIVVDGGYTLP

SEQ ID NO: 519 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaagacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacattgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggaaacacaaaataaatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 520 - protein, 283 aa, Artificial Sequence
  laboratory generated variant based upon the ketoreductase of Candida magnoliae
MAKNFSNVEYPAPAPAHTKDESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 521 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagcccataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggttgacgtcgacctgaaaggcgtaggctatgtagcaaaacatgcgggtcgccatttccgtgaacgtttcgaaaaagaaggcaaaaagggcgccttggtctttacggcttccatgtcgggtcacatcgttaacgtgccgcaatttcaggcggcctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 522 - protein, 283 aa, Artificial Sequence; identical to SEQ ID NO: 506
  laboratory generated variant based upon the ketoreductase of Candida magnoliae

SEQ ID NO: 523 - DNA, 852 bp, Artificial Sequence
  laboratory generated variant based upon the ketoreductase of Candida magnoliae
  CDS (1)..(852)
atggctaaaaacttttccaatgtcgaataccctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgtcattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggaaacacaaaataaatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 524 - protein, 283 aa, Artificial Sequence; identical to SEQ ID NO: 512
  laboratory generated variant based upon the ketoreductase of Candida magnoliae

SEQ ID NO: 525 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaagaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgagaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 526 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 527 - DNA, 852 bp, Artificial Sequence
  laboratory generated variant based upon the ketoreductase of Candida magnoliae
  CDS (1)..(852)
atggctaaaaacttttccaaagtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggaaacacaaaataaatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 528 - protein, 283 aa, Artificial Sequence
  laboratory generated variant based upon the ketoreductase of Candida magnoliae
MAKNFSKVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 529 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 530 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 531 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgagcggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacaaaatagatggtggagcttagttccattgggccgtggcggggaaactgcggaattagttggtgcctacctgttcctggcaagtgatgcgggctcctacgccacgggcacagatatcattgtggacggcggctacacgctgccgtag

SEQ ID NO: 532 - protein, 283 aa, Artificial Sequence
  laboratory generated variant based upon the ketoreductase of Candida magnoliae
MAKNFSNVEYPAPAPAHTKNESLQVLDLFKLSGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGAGYVAKHAGRHFRERFEKEGKKGALVFTASMSGHIVNVPQFQATYNAVKAGVRHFAKSLAVEFAPFARVNSVSPGYINTEISDFVPQETQNRWWSLVPLGRGGETAELVGAYLFLASDAGSYATGTDIIVDGGYTLP

SEQ ID NO: 533 - DNA, 852 bp, Artificial Sequence
  laboratory generated variant based upon the ketoreductase of Candida magnoliae
  CDS (1)..(852)
atggctaaaaacttttccaatgtcgagtatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgcaggctatgtagcaaaacatgcgggtcgccattttcgtgaacgtttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggaaacacaaaataaatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 534 - protein, 283 aa, Artificial Sequence; identical to SEQ ID NO: 512
  laboratory generated variant based upon the ketoreductase of Candida magnoliae

SEQ ID NO: 535 - DNA, 852 bp, Artificial Sequence
  laboratory generated variant based upon the ketoreductase of Candida magnoliae
  CDS (1)..(852)
atggctaaaaacttttccaatgtcggatatcctgccccggcgccagctcataccaaaagcgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggttgacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcggcctacaatgcggtcaaggcaggcgtgcgtcatttcgcaaagtccctggccgtggaatttgctcctttcgcacgtgttaactctgtatctcctggctatattaataccgagatctctgatttcgtcccgcaaggaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 536 - protein, 283 aa, Artificial Sequence
  laboratory generated variant based upon the ketoreductase of Candida magnoliae
MAKNFSNVGYPAPAPAHTKSESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQAAYNAVKAGVRHFAKSLAVEFAPFARVNSVSPGYINTEISDFVPQGTQNKWWSLVPLGRGGETAELVGAYLFLASDAGSYATGTDIIVDGGYTLP

SEQ ID NO: 537 - DNA, 852 bp, Artificial Sequence
  laboratory generated variant based upon the ketoreductase of Candida magnoliae
  CDS (1)..(852)
atggctaaaaacttttccaatgtcggatatcctgccccggcgccagctcataccaaaaacgaatcactgcaggtactggatctgttcaaactgaacggcaaagtcgcgtctatcaccggtagcaactcaggcattggctacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggttgacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcggcctacaatgcggtcaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 538 - protein, 283 aa, Artificial Sequence
  laboratory generated variant based upon the ketoreductase of Candida magnoliae
MAKNFSNVGYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQAAYNAVKAGVRHFAKSLAVEFAPFARVNSVSPGYINTEISDFVPQETQNKWWSLVPLGRGGETAELVGAYLFLASDAGSYATGTDIIVDGGYTLP

SEQ ID NO: 539 - DNA, 852 bp, Artificial Sequence
  laboratory generated variant based upon the ketoreductase of Candida magnoliae
  CDS (1)..(852)
atggctaaaaacttttccaatgtcgaatatcctgccccggcgccagctcataccaaaaacgaatcactgcaggtactggatctgttcaaactgaacggcaaagtcgcgtctatcaccggtagcaactcaggcattggttacgcgctggccgaagcttttgcgcaggttggcgcagacgttgcgatctggtataacagtcatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggtggacgtcgacctgaaaggcgtaggctatgtagcaaaacatgcgggtcgccattttcgtgaacgcttcgaaaaagaaggcaaaaagggcgccttggtctttacggcttccatgtcgggtcacatcgttaatgtgccgcaatttcaggcgacctacaatgcggtcaaggcaggcgtgcgtcatttcgcaaagtccctggccgtggaatttgctcctttcgcacgtgttaactctgtatctcctggctatattaataccgagatctctgatttcgtcccgcaggagacacaaaataaatggtggagcttagttccattgggccgtggcggggaaactgcggaattagttggtgcctacctgttcctggcaagtgatgcgggctcctacgccacgggcacggatatcgttgtggacggcggctacacgctgccgtag

SEQ ID NO: 540 - protein, 283 aa, Artificial Sequence
  laboratory generated variant based upon the ketoreductase of Candida magnoliae
MAKNFSNVEYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQATYNAVKAGVRHFAKSLAVEFAPFARVNSVSPGYINTEISDFVPQETQNKWWSLVPLGRGGETAELVGAYLFLASDAGSYATGTDIVVDGGYTLP

SEQ ID NO: 541 - DNA, 852 bp, Artificial Sequence
  laboratory generated variant based upon the ketoreductase of Candida magnoliae
  CDS (1)..(852)
atggctaaaaacttttccaatgtcggatatcctgccccggcgccagcacataccaaaaacgaatcactgcaggtactggatctgttcaaactgaacggcaaagtcgcgtctatcaccggtagcaactcaggcattggctacgcgctggccgaagcctttgcgcaggttggcgcagacgttgcgatctggtataacagccatgatgccaccggtaaagcagaggccctggctaaaaaatatggcgtaaaagtcaaggcttataaagctaatgtcagctcgagtgatgcggtgaaacagactattgagcagcagatcaaggattttggccacctggacatagttgtggcgaacgcaggcatcccatggactaagggtgcatacatcgatcaggatgacgataaacattttgaccaggtggttgacgtcgacctgaaaggcgtaggctatgtagcaaaacatgcgggtcgccattttcgtgaacgtttcgaaaaagaaggcaaaaagggcgccttggtctttacggcttccatgtcgggtcacatcgttaacgtgccgcaatttcaggcggcctacaatgcggccaaggcaggcgtgcgtcatttcgcaaagtccctggccgtggaatttgctcctttcgcacgtgttaactctgtatctcctggctatattaataccgagatctctgatttcgtcccgcaagaaacacagaataaatggtggagcttagttccattgggccgtggcggggaaactgcggaattagttggtgcctacctgttcctggcaagtgatgcgggctcctacgccacgggcacggatatcattgtggacggcggctacacgctgccgtag

SEQ ID NO: 542 - protein, 283 aa, Artificial Sequence
  laboratory generated variant based upon the ketoreductase of Candida magnoliae
MAKNFSNVGYPAPAPAHTKNESLQVLDLFKLNGKVASITGSNSGIGYALAEAFAQVGADVAIWYNSHDATGKAEALAKKYGVKVKAYKANVSSSDAVKQTIEQQIKDFGHLDIVVANAGIPWTKGAYIDQDDDKHFDQVVDVDLKGVGYVAKHAGRHFRERFEKEGKKGALVFTASMSGHIVNVPQFQAAYNAAKAGVRHFAKSLAVEFAPFARVNSVSPGYINTEISDFVPQETQNKWWSLVPLGRGGETAELVGAYLFLASDAGSYATGTDIIVDGGYTLP

What is claimed is:

1. A non-naturally occurring ketoreductase (KRED) polypeptide capable of converting ethyl 4-chloroacetoacetate to ethyl (S)-4-chloro-3-hydroxybutyrate with at least 1.5 times the KRED activity of the polypeptide of SEQ ID NO: 2, the polypeptide comprising an amino acid sequence that is at least 90% identical to the amino acid sequence of SEQ ID NO: 2 and contains at least an asparagine residue at a position corresponding to position 42 of SEQ ID NO: 2.

2. The KRED polypeptide of claim 1 in lyophilized form.

3. The KRED polypeptide of claim 1, which is isolated.

4. A composition comprising the KRED polypeptide of claim 1 in a buffered medium.

5. The non-naturally occurring KRED polypeptide of claim 1, wherein the KRED polypeptide further comprises a valine residue at a position corresponding to position 194 of SEQ ID NO: 2.

6. The non-natural occurring KRED polypeptide of claim 1, wherein the KRED amino acid sequence comprises a sequence selected from the group consisting of SEQ ID NO: 224, 244, 246, 250, 252, 254, 256, 262, 264, 266, 268, 270, 272, 274, 276, 278, 280, 282, 284, 286, 288, 290, 292, 294, 296, 302, 304, 308, 312, 314, 316, 318, 320, 322, 324, 326, 328, 330, 332, 334, 336, 338, 340, 344, 354, 358, 360, 364, 368, 374, 382, 386, 388, 398, 400, 438, 440, 448, 470, 484, 486, 488, 490, 498, 502, 506, 508, 512, 514, 516, 518, 520, 522, 524, 526, 528, 530, 532, 534, 536, 538, 540, and 542.

7. The non-naturally occurring KRED polypeptide of claim 1, wherein the KRED amino acid sequence comprises a sequence selected from the group consisting of SEQ ID NO:96, 248, 258, 346, 352, 362, 370, 372, 376, 378, 380, 384, 390, 392, 394, 396, 402, 404, 406, 410, 412, 414, 416, 418, 420, 422, 424, 428, 432, 434, 436, 442, 444, 446, 450, 452, 454, 456, 458, 460, 462, 464, 466, 468, 472, 474, 476, 478, 480, 482, 492, 494, 496, 500, 504, and 510.

8. The non-naturally occurring KRED polypeptide of claim 1, wherein the KRED polypeptide has from 5 to about 25 times the KRED activity of the polypeptide of SEQ ID NO:2, and comprises an amino acid sequence selected from the group consisting of SEQ ID NO: 484, 486, 488, 490, 498, 502, 506, 508, 512, 514, 516, 518, 520, 522, 524, 526, 528, 530, 532, 534, 536, 538, 540, and 542.

9. The non-naturally occurring KRED polypeptide of claim 1, wherein the KRED polypeptide has from 9 to about 25 times the KRED activity of the polypeptide of SEQ ID NO: 2 and comprises an amino acid sequence selected from the group consisting of SEQ ID NO: 518, 520, 526, 528, 536, 538, and 540.

10. The non-naturally occurring KRED polypeptide of claim 1, wherein the KRED polypeptide has from 13 to about 25 times the KRED activity of the polypeptide of SEQ ID NO:2 and comprises the amino acid sequence of SEQ ID NO: 536 or 538.

11. The non-naturally occurring KRED polypeptide of claim 1, wherein the KRED amino acid sequence comprises a sequence selected from the group consisting of SEQ ID NO: 344, 440, 506, 526, and 542.

* * * * *

UNITED STATES PATENT AND TRADEMARK OFFICE
CERTIFICATE OF CORRECTION

PATENT NO. : 7,629,157 B2 Page 1 of 1
APPLICATION NO. : 10/916311
DATED : December 8, 2009
INVENTOR(S) : Davis et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 830 days.

Signed and Sealed this

Twenty-first Day of December, 2010

David J. Kappos
*Director of the United States Patent and Trademark Office*